United States Patent 11,066,472 (METHODS OF TREATING CARDIOVASCULAR DISEASE WITH AN ANTI-ASGR ANTIBODY OR BINDING FRAGMENTS THEREOF) - sequence listing, part 3

SEQ ID NO: 26473 - DNA, 321 bp, Artificial Sequence
  Description of Artificial Sequence: Synthetic polynucleotide
gacatccagatgacccagtctccatcctccctgtctgcttctgtacaagacagagtcaccatcacttgccgggcaagtcggggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcaacagcctgcagcctgaagattttgcaacttattactgtctacagcattatagttaccctcggacgttcggccaagggaccaaggtggaaatcaaa

SEQ ID NO: 26474 - protein, 107 aa, Artificial Sequence
  Description of Artificial Sequence: Synthetic polypeptide
DIQMTQSPSSLSASVQDRVTITCRASRGIRNDLGWYQQKPGKAPKRLIYAASSLQSGVPSRFSGSGSGTEFTLTINSLQPEDFATYYCLQHYSYPRTFGQGTKVEIK

SEQ ID NO: 26475 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaccagaaaccggggaaagcccctaagcgcctgatctatgctgcatccactttgcaaagtggggtcccatcaaggttcagcggcagtggatctgggacagaattcactctcacaatcagcagcctgcagcctgaagattttgcaacttattactgtctacagcattatagttacccgctcactttcggcggagggaccaaggtggagatcaaa

SEQ ID NO: 26476 - protein, 107 aa, Artificial Sequence
  Description of Artificial Sequence: Synthetic polypeptide
DIQMTQSPSSLSASVGDRVTITCRASQGIRNDLGWYHQKPGKAPKRLIYAASTLQSGVPSRFSGSGSGTEFTLTISSLQPEDFATYYCLQHYSYPLTFGGGTKVEIK

SEQ ID NO: 26477 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcagggcattagaaatgatttaggctggtatcaggagaaaccagggaaagcccctaaacacctgatctatgctgcatccagtttgcaaaatggggtcccatcaaggttcagcggcagtggatctgggacagagttcactctcacaatcagcagcctgcagcctgaagattttgcaacttattactgtctacagcattatagtttcccgctcactttcggcggagggaccaaggtggagatcaaa

SEQ ID NO: 26478 - protein, 107 aa, Artificial Sequence
  Description of Artificial Sequence: Synthetic polypeptide
DIQMTQSPSSLSASVGDRVTITCRASQGIRNDLGWYQEKPGKAPKHLIYAASSLQNGVPSRFSGSGSGTEFTLTISSLQPEDFATYYCLQHYSFPLTFGGGTKVEIK

SEQ ID NO: 26479 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaactgatttaggctggtttcagcagaaaccagggaaagcccctaagcgcctgatctatactgcatccagtttgcaaagtggggtcccatcaaggttcagcggcagtggatctgggacagaattcactctcacgatcagcagcctgcagcctgaagattttgcaacttattactgtctacagcattatagttacccgctcactttcggcggagggaccaaggtggagatcaaa

SEQ ID NO: 26480 - protein, 107 aa, Artificial Sequence
  Description of Artificial Sequence: Synthetic polypeptide
DIQMTQSPSSLSASVGDRVTITCRASQGIRTDLGWFQQKPGKAPKRLIYTASSLQSGVPSRFSGSGSGTEFTLTISSLQPEDFATYYCLQHYSYPLTFGGGTKVEIK

SEQ ID NO: 26481 - DNA, 321 bp, Artificial Sequence
  Description of Artificial Sequence: Synthetic polynucleotide
gacatccagatgacccagtctccatcctctctgtctgcatctgtaggagacagagtcgccatcacttgtcgggcgagtcaggacattggcaattgtttagcctggtttcagcagaaaccagggaaagcccctaagtccctgatctattctgcgtccagtttgcaaagtggggtcccatcaaagttcagcggcagtggatctgggacagatttcactctcaccatcagcagcctgcagcctgaagattttgcaacttattactgccaacaatctgatagttaccctctcactttcggcggagggaccaaggtggagatcaaa

SEQ ID NO: 26482 - protein, 107 aa, Artificial Sequence
  Description of Artificial Sequence: Synthetic polypeptide
DIQMTQSPSSLSASVGDRVAITCRASQDIGNCLAWFQQKPGKAPKSLIYSASSLQSGVPSKFSGSGSGTDFTLTISSLQPEDFATYYCQQSDSYPLTFGGGTKVEIK

SEQ ID NO: 26483 - DNA, 339 bp, Artificial Sequence
  Description of Artificial Sequence: Synthetic polynucleotide
gacatcgtgatgacccagtctccagactccctggctgtgtctctgggcgcgagggccaccatcaactgcaagtccagccagagtgttttacacagctccaacaattacaactacttagcttggtaccagcagagaccaggacagcctcctaaagtgctcattcactgggcatctacccggaaatccggggtccctgaccgattcagtggcagcgtgtctgggacagatttcactctcaccatcaacagcctgcaggctgaagatgtggcagtttattactgtcagcaatattatagtactccgtggacgttcggccaagggaccaaggtggaaatcaaa

SEQ ID NO: 26484 - protein, 113 aa, Artificial Sequence
  Description of Artificial Sequence: Synthetic polypeptide
DIVMTQSPDSLAVSLGARATINCKSSQSVLHSSNNYNYLAWYQQRPGQPPKVLIHWASTRKSGVPDRFSGSVSGTDFTLTINSLQAEDVAVYYCQQYYSTPWTFGQGTKVEIK

SEQ ID NO: 26485 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcagggcattagaaatgatttaggctggtatcagcagaaaccagggaaagcccctaaacacctgatctatgctgcatccagtttgcaaaatggggtcccatcaaggttcagcggcagtggatctgggacagaattcactctcacaatcagcagcctgcagcctgaagattttgcaacttattactgtctacagcattatagtttcccgctcactttcggcggagggaccaaggtggagatcaga

SEQ ID NO: 26486 - protein, 107 aa, Artificial Sequence
  Description of Artificial Sequence: Synthetic polypeptide
DIQMTQSPSSLSASVGDRVTITCRASQGIRNDLGWYQQKPGKAPKHLIYAASSLQNGVPSRFSGSGSGTEFTLTISSLQPEDFATYYCLQHYSFPLTFGGGTKVEIR

SEQ ID NO: 26487 - DNA, 321 bp, Artificial Sequence; identical to SEQ ID NO: 26479
  Description of Artificial Sequence: Synthetic polynucleotide

SEQ ID NO: 26488 - protein, 107 aa, Artificial Sequence; identical to SEQ ID NO: 26480
  Description of Artificial Sequence: Synthetic polypeptide

SEQ ID NO: 26489 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcagcggcagtggatctgggacagaattcactctcacgatcagcagcctgcagcctgaagattttgcaacttattactgtctacagcattatagttacccgctcactttcggcggagggaccaaggtggagatcaaa

SEQ ID NO: 26490 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFATYYCLQHYSYPLTFGGGTKVEIK

SEQ ID NO: 26491 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtgttaacgactggttagcctggtatcagcagaaaccagggagagcccctaagctcctgatctatgatgcatcaagtttgcaaagtggggtcccatcaaggttcagcggcagtggatctgggacagatttcactctcaccatcagcagcctgcagcctgaagattttgcaacttactattgtcaacaggctaacagtttcccgtggacgttcggccaagggaccaaggtggaaatcaaa

SEQ ID NO: 26492 - protein, 107 aa, Artificial Sequence
  Description of Artificial Sequence: Synthetic polypeptide
DIQMTQSPSSVSASVGDRVTITCRASQGVNDWLAWYQQKPGRAPKLLIYDASSLQSGVPSRFSGSGSGTDFTLTISSLQPEDFATYYCQQANSFPWTFGQGTKVEIK

SEQ ID NO: 26493 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgtatcataatggatacaactatttggattggtacctgcagaagacagggcagtctccacagctcctgatctatgtgggttctaatcgggcctccggggtccctgacaggttcagtggcagtggatcaggcacagattttacactgaaaatcagcagagtggaggctgaggatgttggggtttattactgcatgcaaactctacaaactccgctcactttcggcggagggaccaaggtggagatcaaa

SEQ ID NO: 26494 - protein, 112 aa, Artificial Sequence
  Description of Artificial Sequence: Synthetic polypeptide
DIVMTQSPLSLPVTPGEPASISCRSSQSLLYHNGYNYLDWYLQKTGQSPQLLIYVGSNRASGVPDRFSGSGSGTDFTLKISRVEAEDVGVYYCMQTLQTPLTFGGGTKVEIK

SEQ ID NO: 26495 - DNA, 321 bp, Artificial Sequence
  Description of Artificial Sequence: Synthetic polynucleotide
gccatccagatgacccagtctccatcttccgtgtctgcatctgtaggagacagagtcaccatcacttgtcgggcgagtcagggtattagcaactggttagcctggtatcagcagaaaccagggaaagcccctaacctcatgatccatgctgcattcagtttgcaaggtggggtcccatcaaggttcagcggcagtggatctgggacagatttcactctcaccatcagcagcctgcagcctgaagattttgcaacttactattgtcaacagactaacagtttcccgtggacgttcggccaagggaccaaggtggaaatcaaa

SEQ ID NO: 26496 - protein, 107 aa, Artificial Sequence
  Description of Artificial Sequence: Synthetic polypeptide
AIQMTQSPSSVSASVGDRVTITCRASQGISNWLAWYQQKPGKAPNLMIHAAFSLQGGVPSRFSGSGSGTDFTLTISSLQPEDFATYYCQQTNSFPWTFGQGTKVEIK

SEQ ID NO: 26497 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattaccacctggttagcctggtatcagcagaaaccagggaaagcccctaagctcctgatctatgatgcatccagtttgcaaagtgcggtcccatcaaggttcagcggcagtggatctgggacagatttcactctcaccgtcagcagtttgcagcctgaagattttgcaacttactattgtctacagactaacagtttcccgtggacgttcggccaagggaccaaggtggagatcaag

SEQ ID NO: 26498 - protein, 107 aa, Artificial Sequence
  Description of Artificial Sequence: Synthetic polypeptide
DIQMTQSPSSVSASVGDRVTITCRASQDITTWLAWYQQKPGKAPKLLIYDASSLQSAVPSRFSGSGSGTDFTLTVSSLQPEDFATYYCLQTNSFPWTFGQGTKVEIK

SEQ ID NO: 26499 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaataatttaggctggtatcagcagaaaccagggaaagcccctaagcgcctgatctatcctgcatccagtttgcaaagtggggtcccatcaaggttcagcggcagtggatctgggacagaattcactctcacaatcagcagcctgcagcctgaagattttgcaacttattactgtctacaggatcatagttacccattcactttcggccctgggaccaaagtggatatcaaa

SEQ ID NO: 26500 - protein, 107 aa, Artificial Sequence
  Description of Artificial Sequence: Synthetic polypeptide
DIQMTQSPSSLSASVGDRVTITCRASQGIRNNLGWYQQKPGKAPKRLIYPASSLQSGVPSRFSGSGSGTEFTLTISSLQPEDFATYYCLQDHSYPFTFGPGTKVDIK

SEQ ID NO: 26501 - DNA, 321 bp, Artificial Sequence; identical to SEQ ID NO: 26447
  Description of Artificial Sequence: Synthetic polynucleotide

SEQ ID NO: 26502 - protein, 107 aa, Artificial Sequence; identical to SEQ ID NO: 26448
  Description of Artificial Sequence: Synthetic polypeptide

SEQ ID NO: 26503 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttctattggtacctgcagaagccaggccagcctccacaggtcctgttatttgaagtttcccaccggttctctggagtgccagataggttcagtggcggcgggtcagggacagatttcacactgaagatcagccgggtggaggctgaggatgttggggtttactattgcatgcaaagtatacagtttccgtggacgttcggccaagggaccagggtggacatcaaa

SEQ ID NO: 26504 - protein, 112 aa, Artificial Sequence
  Description of Artificial Sequence: Synthetic polypeptide
DIVMTQTPLSLSVTPGQPASISCKSSQSLLHGDGKTYFYWYLQKPGQPPQVLLFEVSHRFSGVPDRFSGGGSGTDFTLKISRVEAEDVGVYYCMQSIQFPWTFGQGTRVDIK

SEQ ID NO: 26505 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcagggcgttagaaatgatttaggctggtatcagcagaaaccagggaaagcccctaaacacctgatctatgctgcatccagtttgcaaaatggggtcccatcaaggttcagcggcagtggctctgggacagaattcactctcacaatcagcagcctgcagcctgaagattttgccacttattactgtctacaccattatagtttcccgctcactttcggcggagggaccaaggtggagatcaaa

SEQ ID NO: 26506 - protein, 107 aa, Artificial Sequence
  Description of Artificial Sequence: Synthetic polypeptide
DIQMTQSPSSLSASVGDRVTITCRASQGVRNDLGWYQQKPGKAPKHLIYAASSLQNGVPSRFSGSGSGTEFTLTISSLQPEDFATYYCLHHYSFPLTFGGGTKVEIK

SEQ ID NO: 26507 - DNA, 339 bp, Artificial Sequence
  Description of Artificial Sequence: Synthetic polynucleotide
gacatcgtgatgacccagtctccagactccctggcggtgtctctgggcgagagggccaccatcaactgcaagtccagccagagtgttttacacagctccaacaataacaactacttagcttggtaccagcagaaaccaggacagcctcctaagctgctcatttactgggcatctactcgggaatccggggtccctgaccgattcagtggcagcgggtctgggacagatttcattctcaccatcagcggcctgcaggctgaagatgtggcagtttattactgtcagcaatattttactactccgtgcagttttggccaggggaccaagctggagatcaaa

SEQ ID NO: 26508 - protein, 113 aa, Artificial Sequence
  Description of Artificial Sequence: Synthetic polypeptide
DIVMTQSPDSLAVSLGERATINCKSSQSVLHSSNNNNYLAWYQQKPGQPPKLLIYWASTRESGVPDRFSGSGSGTDFILTISGLQAEDVAVYYCQQYFTTPCSFGQGTKLEIK

SEQ ID NO: 26509 - DNA, 324 bp, Artificial Sequence
  Description of Artificial Sequence: Synthetic polynucleotide
gacatccagatgacccagtctccatcctcccggtctgcatgtataggagacagagccaccatcacttaccgtgcaagtcagaccattagcaactatttaaattggtatcagcagaaaccagggaaagcccctaaactccttatctatgctgcatccagtttgcaaattggggtcccatcaaggttcagtggcagtggatctgggacagatttcactctcaccatcagcagtgtgcaacctgaagattttgcaacttacttctgtcaacagagttacagaacccctcagtggacgttcggccaagggaccaaggtggaaatcaaa

SEQ ID NO: 26510 - protein, 108 aa, Artificial Sequence
  Description of Artificial Sequence: Synthetic polypeptide
DIQMTQSPSSRSACIGDRATITYRASQTISNYLNWYQQKPGKAPKLLIYAASSLQIGVPSRFSGSGSGTDFTLTISSVQPEDFATYFCQQSYRTPQWTFGQGTKVEIK

SEQ ID NO: 26511 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatctatgaagtttccaaccggttctctggcgtgccagataggttcagtggcagcgggtcagggacagatttcacactgaaaatcagccgggtggaggctgaggatgttggggtttttttctgcatgcaaagtatacaggttccgtggacgttcggccaagggaccaaggtggaaatcaaa

SEQ ID NO: 26512 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGVFFCMQSIQVPWTFGQGTKVEIK

SEQ ID NO: 26513 - DNA, 333 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgagggaaagacctacttgtattggtacctgcagaagccaggccagcctccacagctcctgatctatgaagtttcccaccggttctctggagtgccagataggttcagtggcagcgggtcagggacagatttcacactgaaaatcagccgggtggaggctgaggatgttggggtttattactgcatgcaaagtatacagcttctcactttcggcggagggaccaaggtggagatcaaa

SEQ ID NO: 26514 - protein, 111 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSHRFSGVPDRFSGSGSGTDFTLKISRVEAEDVGVYYCMQSIQLLTFGGGTKVEIK

SEQ ID NO: 26515 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactacatccagtttgcaaagtggggtcccatcaaggttcagcggcagtggatctgggacagaattcactctcacaatcagcagcctgcagcctgaagattttgcaagttattactgtctacagcattatagtttcccgaacactttcggcggagggaccaaggtggagatcaaa

SEQ ID NO: 26516 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTTSSLQSGVPSRFSGSGSGTEFTLTISSLQPEDFASYYCLQHYSFPNTFGGGTKVEIK

SEQ ID NO: 26517 - DNA, 339 bp, Artificial Sequence
  Description of Artificial Sequence: Synthetic polynucleotide
gacatcgtgatgacccagtctccagattccctggctgtgtctctgggcgcgagggccaccatcaattgcaagtccagccagagtgtattacacagctccaacaattacaactacttaacttggtaccagcagaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatcgtactccgtggacgttcggccaagggaccaaggtggaaatcaaa

SEQ ID NO: 26518 - protein, 113 aa, Artificial Sequence
  Description of Artificial Sequence: Synthetic polypeptide
DIVMTQSPDSLAVSLGARATINCKSSQSVLHSSNNYNYLTWYQQKSGQPPKLLIYWASTRESGVPDRFSGSGSGTDFTLTISSLQAEDVAVYYCQQYYRTPWTFGQGTKVEIK

SEQ ID NO: 26519 - DNA, 321 bp, Artificial Sequence
  Description of Artificial Sequence: Synthetic polynucleotide
gccatccagatgacccagtctccatcttccgtgtctgcatctgtaggagacagagtcaccatcacttgtcgggcgagtcagggtattagcaactggttagcctggtatcagcagaaaccagggaaagcccctaacctcctgatccatgctgcattcagtttgcaaggtggggtcccatcaaggttcagcggcagtggatctgggacagatttcactctcaccatcagcagcctgcagcctgaagattttgcaacttactattgtcaacagactaacagtttcccgtggacgttcggccaagggaccaaggtggaaatcaaa

SEQ ID NO: 26520 - protein, 107 aa, Artificial Sequence
  Description of Artificial Sequence: Synthetic polypeptide
AIQMTQSPSSVSASVGDRVTITCRASQGISNWLAWYQQKPGKAPNLLIHAAFSLQGGVPSRFSGSGSGTDFTLTISSLQPEDFATYYCQQTNSFPWTFGQGTKVEIK

SEQ ID NO: 26521 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagagatgatttaggctggtatcaacagaaaccagggaaagtccctaagcgcctgatatatgctgcatccagtttgcaaagtggggtcccatcaaggttcagcggcagtggatctgggacagaattcactctcacaatcagcagcctacagcctgaagattttgcaacttattactgtcttcagcatcatagttaccctcggacgttcggccaagggaccaaggtggaaatcaaa

SEQ ID NO: 26522 - protein, 107 aa, Artificial Sequence
  Description of Artificial Sequence: Synthetic polypeptide
DIQMTQSPSSLSASVGDRVTITCRASQGIRDDLGWYQQKPGKVPKRLIYAASSLQSGVPSRFSGSGSGTEFTLTISSLQPEDFATYYCLQHHSYPRTFGQGTKVEIK

SEQ ID NO: 26523 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaactgatttaggctggtatcagcagaaaccagggaaagcccctaagcgcctgatctatactgcatccagtttgcaaagtggggtcccatcaaggttcagcggcagtggatctgggacagaattcactctcacgatcagcagcctgcagcctgaagattttgcaacttattactgtctacagcattatagttacccgctcactttcggcggagggaccaaggtggagatcaag

SEQ ID NO: 26524 - protein, 107 aa, Artificial Sequence
  Description of Artificial Sequence: Synthetic polypeptide
DIQMTQSPSSLSASVGDRVTITCRASQGIRTDLGWYQQKPGKAPKRLIYTASSLQSGVPSRFSGSGSGTEFTLTISSLQPEDFATYYCLQHYSYPLTFGGGTKVEIK

SEQ ID NO: 26525 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaatgatttagcctggtttcagcagaaaccagggaaagcccctaagtccctgatcttttctgcatccagtttgcaaagtggggtcccatcaaagttcagcggcagtggatctgggacagatttcactctcaccatcagcagcctgcagcctgaagattttgcaacttattactgccaacaatctgatagttaccctctcactttcggcggagggaccaaggttgagatcaaa

SEQ ID NO: 26526 - protein, 107 aa, Artificial Sequence
  Description of Artificial Sequence: Synthetic polypeptide
DIQMTQSPSSLSASVGDRVTITCRASQDISNDLAWFQQKPGKAPKSLIFSASSLQSGVPSKFSGSGSGTDFTLTISSLQPEDFATYYCQQSDSYPLTFGGGTKVEIK

SEQ ID NO: 26527 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattgggaattatttagcctggtttcagcagaaaccagggaaagcccctaagtccctgatctatgctgcatccggtttgcaaagtgggttcccatcaaaattcagcggcagtggatctgggacagatttcactctcaccatcagcagcctacagcctgaagattttgcaacttattactgccaacagtattatagttacccattcactttcggccctgggaccaaagtggatatcaaa

SEQ ID NO: 26528 - protein, 107 aa, Artificial Sequence
  Description of Artificial Sequence: Synthetic polypeptide
DIQMTQSPSSLSASVGDRVTITCRASQGIGNYLAWFQQKPGKAPKSLIYAASGLQSGFPSKFSGSGSGTDFTLTISSLQPEDFATYYCQQYYSYPFTFGPGTKVDIK

SEQ ID NO: 26529 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattaccgactggttagcctggtatcagcagaaaccagggaaagcccctaagctcctgatctatgctgcatccagtttgcaaagtggggtcccatcaaggttcagcggcagtggatctgggacagatttcactctcaccttcagcagcctgcagcctgacgattttgcaacttactattgtcaacagactaacagtttcccgtggacgttcggccaagggaccaaggtggaaatcaaa

SEQ ID NO: 26530 - protein, 107 aa, Artificial Sequence
  Description of Artificial Sequence: Synthetic polypeptide
DIQMTQSPSSVSASVGDRVTITCRASQGITDWLAWYQQKPGKAPKLLIYAASSLQSGVPSRFSGSGSGTDFTLTFSSLQPDDFATYYCQQTNSFPWTFGQGTKVEIK

SEQ ID NO: 26531 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaataacaactacttagcttggtaccagcagaaaccaggacagcctcctaacctgctcatttactggacatctacccgggaatccggggtccctgaccgattcagtggcagcgggtctgggacaaatttcactctcaccatcagcagcctgcaggctgaagatgtggcagtttattactgtcagcaatattatagtactcctccgacgttcggccaagggaccaaggtggaaatcaaa

SEQ ID NO: 26532 - protein, 113 aa, Artificial Sequence
  Description of Artificial Sequence: Synthetic polypeptide
DIVMTQSPDSLAVSLGERATINCKSSQSVLYSSNNNNYLAWYQQKPGQPPNLLIYWTSTRESGVPDRFSGSGSGTNFTLTISSLQAEDVAVYYCQQYYSTPPTFGQGTKVEIK

SEQ ID NO: 26533 - DNA, 324 bp, Artificial Sequence
  Description of Artificial Sequence: Synthetic polynucleotide
gacatccagatgacccagtctccatcctccctgtctgcatctgtaggagacagagtcatcatcacttgccgggcaagtcagaccattggcaactatttaaattggtatcagcagaaaccagggagagcccctaagctcctgatctatgctgcatccagtttgcacagtggggtcccatcagggttcagtggcagtggatctgggacagatttcactctcaccatcagcagtctgcaacctgaagattttgcaacttacttctgtcaacagagttacagaacccctcagtggacgttcggccaagggaccaaggtggaaatcaaa

SEQ ID NO: 26534 - protein, 108 aa, Artificial Sequence
  Description of Artificial Sequence: Synthetic polypeptide
DIQMTQSPSSLSASVGDRVIITCRASQTIGNYLNWYQQKPGRAPKLLIYAASSLHSGVPSGFSGSGSGTDFTLTISSLQPEDFATYFCQQSYRTPQWTFGQGTKVEIK

SEQ ID NO: 26535 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttgggatttattactgcatgcaaagtatacagattccgtggacgttcggccaagggaccagggtggaaatcaaa

SEQ ID NO: 26536 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGIYYCMQSIQIPWTFGQGTRVEIK

SEQ ID NO: 26537 - DNA, 336 bp, Artificial Sequence; identical to SEQ ID NO: 26451
  Description of Artificial Sequence: Synthetic polynucleotide

SEQ ID NO: 26538 - protein, 112 aa, Artificial Sequence; identical to SEQ ID NO: 26452
  Description of Artificial Sequence: Synthetic polypeptide

SEQ ID NO: 26539 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacactcagcagcctgcagcctgaagattttgcaacttattattgtctacagcattatagttacccgctcactttcggcggagggaccaaggtggagatcaaa

SEQ ID NO: 26540 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASSLQSGVPSRFSGSGSGTEFTLTLSSLQPEDFATYYCLQHYSYPLTFGGGTKVEIK

SEQ ID NO: 26541 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaaccgcctgatctatgctgcatccagtttgcaaagtggggtcccatcacggttcagcggcagtggatctgggacagaattcactctcacaatcagcagcctgcagcgtgaagattttgcaacttattacggtctacagcataatagttaccctcgcagttttggccaggggaccaagctggagatcaaa

SEQ ID NO: 26542 - protein, 107 aa, Artificial Sequence
  Description of Artificial Sequence: Synthetic polypeptide
DIQMTQSPSSLSASVGDRVTITCRASQGIRNDLGWYQQKPGKAPNRLIYAASSLQSGVPSRFSGSGSGTEFTLTISSLQREDFATYYGLQHNSYPRSFGQGTKLEIK

SEQ ID NO: 26543 - DNA, 321 bp, Artificial Sequence
  Description of Artificial Sequence: Synthetic polynucleotide
gacatccagatgtcccagtctccatcctcactgtctgcttctgtaggagacagagtcaccatcacttgtcgggcgagtcagggcattaccaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaaagtggatatcaaa

SEQ ID NO: 26544 - protein, 107 aa, Artificial Sequence
  Description of Artificial Sequence: Synthetic polypeptide
DIQMSQSPSSLSASVGDRVTITCRASQGITNYLAWFQQKPGKAPKSLIYAASSLQSGVPSKFSGSGSGTDFTLTISSLQPEDFATYYCQQYNSYPFTFGPGTKVDIK

SEQ ID NO: 26545 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcattatagtttccctcgcagttttggccaggggaccaagctggagatcaaa

SEQ ID NO: 26546 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHYSFPRSFGQGTKLEIK

SEQ ID NO: 26547 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagcaatgatttaggctggtatcagcagaaaccagggaaagcccctaagcgcctgatctatgctgcatccagtttgcaaagtggggtcccatcaaggttcagcggcagtggttctgggacagaattcactctcacaatcaacagcctgcagcctgaagattttgcaacttattactgtctacagcttaatagttacccattcactttcggccctgggaccaaagtggatatcaaa

SEQ ID NO: 26548 - protein, 107 aa, Artificial Sequence
  Description of Artificial Sequence: Synthetic polypeptide
DIQMTQSPSSLSASVGDRVTITCRASQDISNDLGWYQQKPGKAPKRLIYAASSLQSGVPSRFSGSGSGTEFTLTINSLQPEDFATYYCLQLNSYPFTFGPGTKVDIK

SEQ ID NO: 26549 - DNA, 336 bp, Artificial Sequence
  Description of Artificial Sequence: Synthetic polynucleotide
gatattgtgatgacccagactccactctctctgtccgtcactcctggacagccggcctccatctcctgcaagtctagtcagcgcctcctgcatggtgatggaaagacctatttgtattggtacctgcagaagccaggccagcctccacagatcctgatctatgaagtttccaaccggttctctggagtgccagataggttcagtggcagcgggtcagggacagagttcacacttaaaatcagccgggtggaggctgaggatgttggggtttattactgcatgcaaagtatacagattccgtggacgttcggccaagggaccaaggtggaaatcaaa

SEQ ID NO: 26550 - protein, 112 aa, Artificial Sequence
  Description of Artificial Sequence: Synthetic polypeptide
DIVMTQTPLSLSVTPGQPASISCKSSQRLLHGDGKTYLYWYLQKPGQPPQILIYEVSNRFSGVPDRFSGSGSGTEFTLKISRVEAEDVGVYYCMQSIQIPWTFGQGTKVEIK

SEQ ID NO: 26551 - DNA, 339 bp, Artificial Sequence
  Description of Artificial Sequence: Synthetic polynucleotide
gacatcgtgatgacccagtctccagactccctggctgtgtctctgggcgagagggctaccgtcaactgcaagtccagccagagtgttttacacagctccaacaataacaactacttaacttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtagtcctccgacgttcggccaagggaccaaggtggaaatcaaa

SEQ ID NO: 26552 - protein, 113 aa, Artificial Sequence
  Description of Artificial Sequence: Synthetic polypeptide
DIVMTQSPDSLAVSLGERATVNCKSSQSVLHSSNNNNYLTWYQQKPGQPPKLLIYWASTRESGVPDRFSGSGSGTDFTLTISSLQAEDVAVYYCQQYYSSPPTFGQGTKVEIK

SEQ ID NO: 26553 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactggttagcctggtatcagcagaaaccagggaaagcccctaagctcctgatctatgctgcttccagtttgcaaagtggggtcccatcaaggttcaacggcagtggatctgggacagatttcactctcaccatcagcagcctgcagcctgaagattttgcaacttactgttgtcaacaggctaacagtttaccgtggacgttcggccaagggaccaaggtggaaatcaaa

SEQ ID NO: 26554 - protein, 107 aa, Artificial Sequence
  Description of Artificial Sequence: Synthetic polypeptide
DIQMTQSPSSVSASVGDRVTITCRASQGISNWLAWYQQKPGKAPKLLIYAASSLQSGVPSRFNGSGSGTDFTLTISSLQPEDFATYCCQQANSLPWTFGQGTKVEIK

SEQ ID NO: 26555 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattactgactggttagcctggtatcagcagaaaccagggaaagcccctaaactcctgatctctgctgcatccagtttgcagagtggggtcccatcaaggttcagcggcagtggatctgggacagatttcactctcgccatcagcagcctgcagcctgaagattttgcaacttactattgtcaacaggctaacagtttaccgtggacgttcggccaagggaccaaggtggaaatcaaa

SEQ ID NO: 26556 - protein, 107 aa, Artificial Sequence
  Description of Artificial Sequence: Synthetic polypeptide
DIQMTQSPSSVSASVGDRVTITCRASQDITDWLAWYQQKPGKAPKLLISAASSLQSGVPSRFSGSGSGTDFTLAISSLQPEDFATYYCQQANSLPWTFGQGTKVEIK

SEQ ID NO: 26557 - DNA, 321 bp, Artificial Sequence
  Description of Artificial Sequence: Synthetic polynucleotide
gacatccagatgacccagtctccatcctccctgtctgcatctgtcggagacagagtcaccatcacttgccgggcaagtcagggcattagaaatgatttaggctggtatcagcagaaaccagggaaagcccctaaacacctgatctatgctgcatccagtttgcaaaatggggtcccatcaaggttcagcggcagtggctctgggacagaattcactctcacaatcagcagcctgcagcctgaagattttgccacttattactgtctacaccattatagtttcccgctcactttcggcggagggaccaaggtggagatcaaa

SEQ ID NO: 26558 - protein, 107 aa, Artificial Sequence
  Description of Artificial Sequence: Synthetic polypeptide
DIQMTQSPSSLSASVGDRVTITCRASQGIRNDLGWYQQKPGKAPKHLIYAASSLQNGVPSRFSGSGSGTEFTLTISSLQPEDFATYYCLHHYSFPLTFGGGTKVEIK

SEQ ID NO: 26559 - DNA, 336 bp, Artificial Sequence
  Description of Artificial Sequence: Synthetic polynucleotide
catattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatctatgaagtttccaaccggttttctggagtgccagacagactcagtggcggcgggtcagggacagatttcacactgaaaatcagccgggtggaggctgaggatgttggcatttattactgcatgcaaagtatacaggttccgtggacgttcggccaagggaccaaggtggaaatcaaa

SEQ ID NO: 26560 - protein, 112 aa, Artificial Sequence
  Description of Artificial Sequence: Synthetic polypeptide
HIVMTQTPLSLSVTPGQPASISCKSSQSLLHGDGKTYLYWYLQKPGQPPQLLIYEVSNRFSGVPDRLSGGGSGTDFTLKISRVEAEDVGIYYCMQSIQVPWTFGQGTKVEIK

SEQ ID NO: 26561 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattagcgactggttagcctggtatcagcaaaaatcagggaaagcccctaaactcctgatctctgctgcatccagtttgcaaagtggggtcccatcaaggttcggcggcagtggatctgggacagatttcactctcaccatcagcagcctgcagcctgaagattttgcaacttactattgtcaacaggctaacagtttaccgtggacgttcggccaagggaccaaggtggaaatcaaa

SEQ ID NO: 26562 - protein, 107 aa, Artificial Sequence
  Description of Artificial Sequence: Synthetic polypeptide
DIQMTQSPSSVSASVGDRVTITCRASQDISDWLAWYQQKSGKAPKLLISAASSLQSGVPSRFGGSGSGTDFTLTISSLQPEDFATYYCQQANSLPWTFGQGTKVEIK

SEQ ID NO: 26563 - DNA, 333 bp, Artificial Sequence
  Description of Artificial Sequence: Synthetic polynucleotide
gatattgtgatgacccagactccactctctctgtccgtcacccctggacagccggcctccatctcctgcaaatctagtcagagcctcctgcatagtgagggaaagacctacttgtattggtacctgcagaagccaggccagcctccacagctcctgatctatgaggtttcccaccggttctctggagtgccagataggttcagtggcagcgggtcagggacagatttcacactgaaaatcagccgggtggaggctgaggatgttggggtttattactgcatgcaaagtatacaggttctcactttcggcggagggaccaaggtggagatcaaa

SEQ ID NO: 26564 - protein, 111 aa, Artificial Sequence
  Description of Artificial Sequence: Synthetic polypeptide
DIVMTQTPLSLSVTPGQPASISCKSSQSLLHSEGKTYLYWYLQKPGQPPQLLIYEVSHRFSGVPDRFSGSGSGTDFTLKISRVEAEDVGVYYCMQSIQVLTFGGGTKVEIK

SEQ ID NO: 26565 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcaggatattaccagctggttagcctggtatcagcagaaaccagggaaagcccctaagctcctgatctatgctgcatccagtttgcaaagtggggtcccatcaaggttcagcggcagtggatctgggacagatttcattctcaccatcagcagcctgcagcctgaagattttgcattttaccattgtcaacaggctaacagtatcccattcactttcggccctgggaccaaagtggacatcaac

SEQ ID NO: 26566 - protein, 107 aa, Artificial Sequence
  Description of Artificial Sequence: Synthetic polypeptide
DIQMTQSPSSVSASVGDRVTITCRASQDITSWLAWYQQKPGKAPKLLIYAASSLQSGVPSRFSGSGSGTDFILTISSLQPEDFAFYHCQQANSIPFTFGPGTKVDIN

SEQ ID NO: 26567 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatctatgcaacttccaaccggttccctggagtgtcagataggttcagtggcagcgggtcaggtacagacttcacactgaaaatcagccgggtggaggctgaggatgttggggtttattactgcatgcaaagtatacaggttccgtggacgttcggccaagggaccaaggtggaaatcaaa

SEQ ID NO: 26568 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYATSNRFPGVSDRFSGSGSGTDFTLKISRVEAEDVGVYYCMQSIQVPWTFGQGTKVEIK

SEQ ID NO: 26569 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatactgcatccagtttgcaaagtggggtcccatcaaggttcagcggcagtggatctgggacagaattcactctcacaatcagcagcctgcagcctgaagattttgcatcttattactgtctacagcataatagttacccattcactttcggccctgggaccaaagtggatttcaaa

SEQ ID NO: 26570 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTEFTLTISSLQPEDFASYYCLQHNSYPFTFGPGTKVDFK

SEQ ID NO: 26571 - DNA, 321 bp, Artificial Sequence
  Description of Artificial Sequence: Synthetic polynucleotide
gacatccagatgacccagtctccatcctccctgtctgcatctgtaggagacggagtcaccatcacttgccgggcaagtcagaccattctcagctatttaaattggtatcagcagaaaccagggaaagcccctaaactcctgatctatggtgtatccagtttacaaagtggggtcccatcaaggttcagtggcagtggatctgggacagatttctctctcaccatcagcagtctgcaacctgaagattttgcaacttactactgtcagcagagttacagtaccccattcactttcggccctgggaccaaagtggatatcaaa

SEQ ID NO: 26572 - protein, 107 aa, Artificial Sequence
  Description of Artificial Sequence: Synthetic polypeptide
DIQMTQSPSSLSASVGDGVTITCRASQTILSYLNWYQQKPGKAPKLLIYGVSSLQSGVPSRFSGSGSGTDFSLTISSLQPEDFATYYCQQSYSTPFTFGPGTKVDIK

SEQ ID NO: 26573 - DNA, 336 bp, Artificial Sequence
  Description of Artificial Sequence: Synthetic polynucleotide
gaaattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatccatgaagtttccaaccggttctctggagtgccagataggttcagtggcagcgggtcagggacagatttcacactgaaaatcagccgggtggaggctgaggatgttggggtttattactgcatgcaaagtatacaggttccctggacgttcggccaagggaccaaggtggaaatcaaa

SEQ ID NO: 26574 - protein, 112 aa, Artificial Sequence
  Description of Artificial Sequence: Synthetic polypeptide
EIVMTQTPLSLSVTPGQPASISCKSSQSLLHGDGKTYLYWYLQKPGQPPQLLIHEVSNRFSGVPDRFSGSGSGTDFTLKISRVEAEDVGVYYCMQSIQVPWTFGQGTKVEIK

SEQ ID NO: 26575 - DNA, 321 bp, Artificial Sequence
  Description of Artificial Sequence: Synthetic polynucleotide
gacatccagatgacccagtctccatcctcactgtctgcatctataggagagagagtcaccatcacttgtcgggcgagtcagggcattagcaattatttagcctggattcagcagaaaccagggacagcccctaagtccctgatctatgctgcatccagtttgcaaagtggggtctcatcaaggttcagcggcagtggatttgggacagatttcactctcaccatcagtagtctgcagcctgaagattttgcaacttattactgccaacagtataatggttacccattcactttcggccctgggaccaaagtggatatcaaa

SEQ ID NO: 26576 - protein, 107 aa, Artificial Sequence
  Description of Artificial Sequence: Synthetic polypeptide
DIQMTQSPSSLSASIGERVTITCRASQGISNYLAWIQQKPGTAPKSLIYAASSLQSGVSSRFSGSGFGTDFTLTISSLQPEDFATYYCQQYNGYPFTFGPGTKVDIK

SEQ ID NO: 26577 - DNA, 324 bp, Artificial Sequence
  Description of Artificial Sequence: Synthetic polynucleotide
gacatccagatgacccagtctccatcctccctgtctgcatctgtaggagacagagtcaacatcacttgccgggcaagtcacagcattagcaactatttaaattggtatcagcagaaagcagggaaagcccctaacctcttgatctatactacattgaatttgcaaagtggggtcccatcaaggttcagtggcagtggatctgggacagatttcactctcaccatcagcagtctgcaacctgaagattttgcaacttactactgtcaacagagttacagttctcctccgtggacgttcggccaagggaccaaggtggaaatcaaa

SEQ ID NO: 26578 - protein, 108 aa, Artificial Sequence
  Description of Artificial Sequence: Synthetic polypeptide
DIQMTQSPSSLSASVGDRVNITCRASHSISNYLNWYQQKAGKAPNLLIYTTLNLQSGVPSRFSGSGSGTDFTLTISSLQPEDFATYYCQQSYSSPPWTFGQGTKVEIK

SEQ ID NO: 26579 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaattacaactacttaacttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcagtattttattactccgtggacgttcggccaagggaccaaggtggaaatcaaa

SEQ ID NO: 26580 - protein, 113 aa, Artificial Sequence
  Description of Artificial Sequence: Synthetic polypeptide
DIVMTQSPDSLAVSLGERATINCKSSQSVLHSSNNYNYLTWYQQKPGQPPKLLIYWASTRESGVPDRFSGSGSGTDFTLTISSLQAEDVAVYYCHQYFITPWTFGQGTKVEIK

SEQ ID NO: 26581 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccaggaaaagcccctaagcgcctgatctatactgcatccagtttgcaaagtggggtcccatcaaggttcagcggcagtggatctgggacagatttcactctcacaatcagcagcctgcagcctgaagattttgcatcttattactgtctacagcataatagttacccattcactttcggccctgggaccaaagtggatttcaaa

SEQ ID NO: 26582 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYTASSLQSGVPSRFSGSGSGTDFTLTISSLQPEDFASYYCLQHNSYPFTFGPGTKVDFK

SEQ ID NO: 26583 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaagccaggccagcctccacagctcctgatctatgaagtttccaatcggttctctggagtgccagataggttcagtggcagcgggtcagggacagatttcacacttaaaatcagccgggtggaggctgaggatgttggggtttatcactgcatgcaaagtatacagattccctggacgttcggccaagggaccaaggtggaaatcaaa

SEQ ID NO: 26584 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGVYHCMQSIQIPWTFGQGTKVEIK

SEQ ID NO: 26585 - DNA, 321 bp, Artificial Sequence
  Description of Artificial Sequence: Synthetic polynucleotide
gacatccagatgacccagtctccatcttccgtgtatgcatctgttggagacagagtcaccatcacttgtcgggcgagtcaggatattaccagctggttagcctggtatcagcagaaaccagggaaagcccctaaactcctgatctatgctgcatccagtttacaaagtggggtcccatcaaggttcagcggcagtggatctgggacagatttcattctcaccatcaccagcgtgcagcctgatgattttgcaacttactattgtcaacaggttaacagtttcccattcactttcggccacgggaccaaagtggatatcaaa

SEQ ID NO: 26586 - protein, 107 aa, Artificial Sequence
  Description of Artificial Sequence: Synthetic polypeptide
DIQMTQSPSSVYASVGDRVTITCRASQDITSWLAWYQQKPGKAPKLLIYAASSLQSGVPSRFSGSGSGTDFILTITSVQPDDFATYYCQQVNSFPFTFGHGTKVDIK

SEQ ID NO: 26587 - DNA, 321 bp, Artificial Sequence
  Description of Artificial Sequence: Synthetic polynucleotide
gacatccagatgacccagtctccatcctccctgtctgcatctgtaggagacagagtcaccatcgcttgccaggcgagtcaggacattagcaactatttaaattggtatcagcagacaccagggaaagcccctaaggtcctgatctacgatgcatccaatttggaaacaggggtcccagcaaggttcagtggaagtggatctgggacagattttactttcaccatcagcagcctgcagcctgaagatattgcaacatattactgtcaacagtatgataatctccctctcactttcggcggagggaccaaggtggacatcaaa

SEQ ID NO: 26588 - protein, 107 aa, Artificial Sequence
  Description of Artificial Sequence: Synthetic polypeptide
DIQMTQSPSSLSASVGDRVTIACQASQDISNYLNWYQQTPGKAPKVLIYDASNLETGVPARFSGSGSGTDFTFTISSLQPEDIATYYCQQYDNLPLTFGGGTKVDIK

SEQ ID NO: 26589 - DNA, 324 bp, Artificial Sequence
  Description of Artificial Sequence: Synthetic polynucleotide
gacatccagatgacccagtctccatcctccctgtgtgcctctgtaggagacagagtcaccatcacttgccgggcaagtcggaacatcagcaactatttaaattggtatcagcagaaaccagggaaagcccctaagctcctgatctatgttgtatccagtttgcaaagtggggtcccatcaaggttcagtggcagtggatctgggacagatttcactctcaccatcagcagtctacaacctgaagattttgcaacttactactgtcaacagagttacagttcccctccgtggacgttcggccaagggaccaaggtggatatcaga

SEQ ID NO: 26590 - protein, 108 aa, Artificial Sequence
  Description of Artificial Sequence: Synthetic polypeptide
DIQMTQSPSSLCASVGDRVTITCRASRNISNYLNWYQQKPGKAPKLLIYVVSSLQSGVPSRFSGSGSGTDFTLTISSLQPEDFATYYCQQSYSSPPWTFGQGTKVDIR

SEQ ID NO: 26591 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtccgagtgttagcagcagattcttagcctggtaccagcagaaacctggccaggctcccaggctcctcatctatggtgcatccagcagggccactggcatcccagacaggttcagtggcagtgggtctgggacagacttcactctcaccaacagcagactggagcctgaagattttgcagtgtattactgtcagcagtatggtagctcacctccgtggacgttcggccaagggaccaaggtagaaatcaaa

SEQ ID NO: 26592 - protein, 109 aa, Artificial Sequence
  Description of Artificial Sequence: Synthetic polypeptide
EIVLTQSPGTLSLSPGERATLSCRASPSVSSRFLAWYQQKPGQAPRLLIYGASSRATGIPDRFSGSGSGTDFTLTNSRLEPEDFAVYYCQQYGSSPPWTFGQGTKVEIK

SEQ ID NO: 26593 - DNA, 321 bp, Artificial Sequence
  Description of Artificial Sequence: Synthetic polynucleotide
gaaattgtgctgactcagtctccagactttcagtctgtggctccaaaggagaaagtcaccatcacctgccgggccagtcagagtattggtagtaacttacactggtaccagcagaaaccagatcagtctccgaaactcctcatcaagtctgcttcccagtccttctcaggggtcccctcgaggttcagtggcagtggatctgggacagatttcaccctcaccatcaatagcctggaaactgaagatgctgcaacgtattactgtcagcagagtagtagtttaccgtggacgttcggccaagggaccaaggtggaaatcaaa

SEQ ID NO: 26594 - protein, 107 aa, Artificial Sequence
  Description of Artificial Sequence: Synthetic polypeptide
EIVLTQSPDFQSVAPKEKVTITCRASQSIGSNLHWYQQKPDQSPKLLIKSASQSFSGVPSRFSGSGSGTDFTLTINSLETEDAATYYCQQSSSLPWTFGQGTKVEIK

SEQ ID NO: 26595 - DNA, 321 bp, Artificial Sequence
  Description of Artificial Sequence: Synthetic polynucleotide
gacatccagatgacccagtctccttcctcactgtctgcatctgtaggagacagagtcaccatcacttgtcggacgagtcagggcattggcaattatttagcctggtttcagcagaaaccagggaaagcccctaagtccctgctctataaaacatccagtttacaaagtggggtcccatcaaagttcagcggcagtggatctgggacagatttcactctcaccatcagcagcctgcagcctgaagattttgcaacttattactgccaacagtatatgacttacccgctcactttcggcggagggaccaaggtggagatcaaa

SEQ ID NO: 26596 - protein, 107 aa, Artificial Sequence
  Description of Artificial Sequence: Synthetic polypeptide
DIQMTQSPSSLSASVGDRVTITCRTSQGIGNYLAWFQQKPGKAPKSLLYKTSSLQSGVPSKFSGSGSGTDFTLTISSLQPEDFATYYCQQYMTYPLTFGGGTKVEIK

SEQ ID NO: 26597 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagttttcgcatcaacttagcctggtaccagcagagacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgctcactttcggcggagggaccaaggtggagatcaaa

SEQ ID NO: 26598 - protein, 107 aa, Artificial Sequence
  Description of Artificial Sequence: Synthetic polypeptide
EIVMTQSPATLSVSPGERATLSCRASQSFRINLAWYQQRPGQAPRLLIYGASTRATGIPARFSGSGSGTEFTLTISSLQSEDFAVYYCQQYNNWPLTFGGGTKVEIK

SEQ ID NO: 26599 - DNA, 321 bp, Artificial Sequence
  Description of Artificial Sequence: Synthetic polynucleotide
gaaattgtgctgactcagtttccagactctcagtctgtgactccaaaggagaaagtcaccatcacctgccgggccagtcagaacattggtagtagcttacactggtaccagcagaaaccagaacagtctccaaaggtcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtagtttccctcggacgttcggccaagggaccaaggtggaaatcaaa

SEQ ID NO: 26600 - protein, 107 aa, Artificial Sequence
  Description of Artificial Sequence: Synthetic polypeptide
EIVLTQFPDSQSVTPKEKVTITCRASQNIGSSLHWYQQKPEQSPKVLIKYASQSFSGVPSRFSGSGSGTDFTLTINSLEAEDAATYYCHQSSSFPRTFGQGTKVEIK

SEQ ID NO: 26601 - DNA, 321 bp, Artificial Sequence
  Description of Artificial Sequence: Synthetic polynucleotide
gacatccagatgacccagtctccttcctcactgtctgcatctgtaggagacagagtcaccatcacttgtcggacgagtcagggcattggcaattatttagcctggtttcagcagaaaccagggaaagcccctaagtccctgctctataaagcatccagtttgcaaagtggggtcccatcaaagttcagcggcagtggatctgggacagatttcactctcaccatcagcagcctgcagcctgaagattttgcaacttattactgccaacagtatatgacttacccgctcactttcggcggagggaccaaggtggagatcaaa

SEQ ID NO: 26602 - protein, 107 aa, Artificial Sequence
  Description of Artificial Sequence: Synthetic polypeptide
DIQMTQSPSSLSASVGDRVTITCRTSQGIGNYLAWFQQKPGKAPKSLLYKASSLQSGVPSKFSGSGSGTDFTLTISSLQPEDFATYYCQQYMTYPLTFGGGTKVEIK

SEQ ID NO: 26603 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctccatagtgatggaaggacctatttgtattggtacctgcagaagccaggccagcctccacagctcctgatctgtgaggtttccaaccggttcgctggagtgacagataggttcagtggcagcgggtcagggacagatttcacactgaaaatcagccgggtggaggctggggatgttggggtttattactgcatgcaaagtatacagtttccctggacgttcggccaagggaccaaggtggaaatcaaa

SEQ ID NO: 26604 - protein, 112 aa, Artificial Sequence
  Description of Artificial Sequence: Synthetic polypeptide
DIVMTQTPLSLSVTPGQPASISCKSSQSLLHSDGRTYLYWYLQKPGQPPQLLICEVSNRFAGVTDRFSGSGSGTDFTLKISRVEAGDVGVYYCMQSIQFPWTFGQGTKVEIK

SEQ ID NO: 26605 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagtattggtagtagcttacactggtaccagcagaaaccagatcagtctccaaagctcctcatcaagtatgcttcccagtccttctcaggggacccctcgaggttcagtggcagtggatctgggacagatttcaccctcaccatcaatagcctggaagctgaagatgctgcaacgtattactgtcatcagactagaagtttacctctcactttcggcggagggaccaaggtggagatcaaa

SEQ ID NO: 26606 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGDPSRFSGSGSGTDFTLTINSLEAEDAATYYCHQTRSLPLTFGGGTKVEIK

SEQ ID NO: 26607 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaaagatttaggctggtatcagcagaaaccagggaaagcccctaagcgcctgatccatactgcatccagtttgcaaagtggggtcccattaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 26608 - protein, 107 aa, Artificial Sequence
  Description of Artificial Sequence: Synthetic polypeptide
DIQMTQSPSSLSASVGDRVTITCRASQGIRKDLGWYQQKPGKAPKRLIHTASSLQSGVPLRFSGSGSGTEFTLTISSLQPEDFATYYCLQHNSYPWTFGQGTKVEIK

SEQ ID NO: 26609 - DNA, 321 bp, Artificial Sequence
  Description of Artificial Sequence: Synthetic polynucleotide
gacattcagatgacccagtctccatcctccctgtctgcatctgtaggagacagagtcaccatcacttgccgggcgagtcagggcattagcaattatttagcctggtatcagcagaaaccagggaaagtccctaaactcctgatctatgttgcatccactttgcaatcaggggtcccatctcggttcagtggcagtggatctgggacagatttcactctcaccatcagcagcctgcagcctgaagatgttgcaacttattactgtcaaaagtataacagtgccccattcactttcggccctgggaccaaagtggatatcaaa

SEQ ID NO: 26610 - protein, 107 aa, Artificial Sequence
  Description of Artificial Sequence: Synthetic polypeptide
DIQMTQSPSSLSASVGDRVTITCRASQGISNYLAWYQQKPGKVPKLLIYVASTLQSGVPSRFSGSGSGTDFTLTISSLQPEDVATYYCQKYNSAPFTFGPGTKVDIK

SEQ ID NO: 26611 - DNA, 321 bp, Artificial Sequence
  Description of Artificial Sequence: Synthetic polynucleotide
gacatccagatgacccagtctccatcctcactgtctgcatctgtgggagacagagtcaccatcacttgtcgggcgagtcagggcattggcaagtatttagcctggtttcagcagaaaccagggaaagcccctaagtcactgatctatgctgcatccagtttgcaaagtggggtcccatcaaaattcagcggcagtggatctgggacagatttcactctcaccatcagcagcctgcagcctgacgattttgcaacttattactgccaacgatatgatacttacccattcactttcggccctgggaccaaagtggatatcaaa

SEQ ID NO: 26612 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYAASSLQSGVPSKFSGSGSGTDFTLTISSLQPDDFATYYCQRYDTYPFTFGPGTKVDIK

SEQ ID NO: 26613 - DNA, 321 bp, Artificial Sequence
  Description of Artificial Sequence: Synthetic polynucleotide
gacatccagatggcccagtctccttcctcactgtctgcatctgtaggagacagagtcaccatcacttgtcggacgagtcagggcattggcaagtatttagcctggtttcagcagaagccagggaaagcccctaagtccctgctctataaagcatccagtttgcaaggtggggtcccatcaaagttcagcggcagtggatctgggacagatttcactctcaccatcagcagcctgcagcctgaagattttgcaacttattactgccaacagtatatgacttacccgctcactttcggcggagggaccaaggtggagatcaaa

SEQ ID NO: 26614 - protein, 107 aa, Artificial Sequence
  Description of Artificial Sequence: Synthetic polypeptide
DIQMAQSPSSLSASVGDRVTITCRTSQGIGKYLAWFQQKPGKAPKSLLYKASSLQGGVPSKFSGSGSGTDFTLTISSLQPEDFATYYCQQYMTYPLTFGGGTKVEIK

SEQ ID NO: 26615 - DNA, 336 bp, Artificial Sequence
  Description of Artificial Sequence: Synthetic polynucleotide
gacattgtgatgacccagactccactctctctgtccgtcacccctggacagccggcctccatctcctgtaggtctagtcagagcctcctgcatagtgatggaaagacctatttgttttggtacctgcagaagccaggccagcctccacaggtcctgatctatgaactttccaaccggttctctggagtgccagataggttcagtggcagcgggtcagggacagatttcacactgaaaatcagccgggtggaggctgaggatgttggggtttattactgcatgcaaagtttccagcttccctggacgttcggtcaagggaccaaggtggaaatcaat

SEQ ID NO: 26616 - protein, 112 aa, Artificial Sequence
  Description of Artificial Sequence: Synthetic polypeptide
DIVMTQTPLSLSVTPGQPASISCRSSQSLLHSDGKTYLFWYLQKPGQPPQVLIYELSNRFSGVPDRFSGSGSGTDFTLKISRVEAEDVGVYYCMQSFQLPWTFGQGTKVEIN

SEQ ID NO: 26617 - DNA, 339 bp, Artificial Sequence
  Description of Artificial Sequence: Synthetic polynucleotide
gacatcatgatgacccagtctccagactccctggctgtgtctctgggcgagagggccatcatcagctgcaggtccagccagagtgttttacacagctccaacaattacaactacttagcttggtaccagcagaaaccaggacatcctcctaaactgctcatttactgggcatctacccgggaatccggggtccctgaccgattcagtggcagcgggtctgggacagatttcactctcaccatcagcagcctgcaggctgaagatgtggcagtttattactgtcaacaatattatagtactcctccgacgttcggcctagggaccaaggtggaaatcaaa

SEQ ID NO: 26618 - protein, 113 aa, Artificial Sequence
  Description of Artificial Sequence: Synthetic polypeptide
DIMMTQSPDSLAVSLGERAIISCRSSQSVLHSSNNYNYLAWYQQKPGHPPKLLIYWASTRESGVPDRFSGSGSGTDFTLTISSLQAEDVAVYYCQQYYSTPPTFGLGTKVEIK

SEQ ID NO: 26619 - DNA, 324 bp, Artificial Sequence
  Description of Artificial Sequence: Synthetic polynucleotide
gaaattgtgttgacgcagtctccaggcaccctgtctttgtctccaggggaaagagccgccctctcctgcagggccagtcagagtattagcctcaacttcttagcctggtaccagcagaaacctggccaggctcccaggctcctcatctatggtgcatccagcagggccactggcatcccagacaggttcagtggcagtgggtctgggacagacttcactctcaccatcaatagactggagcctgaagattttgcagtgtattactgtcagcagtatggtaggtcaccgtggacgttcggccaagggaccaaggtggaagtcaaa

SEQ ID NO: 26620 - protein, 108 aa, Artificial Sequence
  Description of Artificial Sequence: Synthetic polypeptide
EIVLTQSPGTLSLSPGERAALSCRASQSISLNFLAWYQQKPGQAPRLLIYGASSRATGIPDRFSGSGSGTDFTLTINRLEPEDFAVYYCQQYGRSPWTFGQGTKVEVK

SEQ ID NO: 26621 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctggaacagatttcactctcaccatcagcagcctgcagcctgaagattttgcaacttattactgccaacattatcttacttaccctctcactttcggcggagggaccaaggtggagatcaaa

SEQ ID NO: 26622 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQHYLTYPLTFGGGTKVEIK

SEQ ID NO: 26623 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattcgcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtaactcaccgtgggcgttcggccaagggaccaaggtggaagtcaaa

SEQ ID NO: 26624 - protein, 108 aa, Artificial Sequence
  Description of Artificial Sequence: Synthetic polypeptide
EIVLTQSPGTLSLSPGERATLSCRASQSIRSSFLAWYQQKPGQAPRLLIYGASSRATGIPDRFSGSGSGTDFTLTISRLEPEDFAVYYCQQYGNSPWAFGQGTKVEVK

SEQ ID NO: 26625 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattcgcagcagcttcttagcctggtatcagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtaactcaccgtgggcgttcggccaagggaccaaggtggaaatcaaa

SEQ ID NO: 26626 - protein, 108 aa, Artificial Sequence
  Description of Artificial Sequence: Synthetic polypeptide
EIVLTQSPGTLSLSPGERATLSCRASQSIRSSFLAWYQQKPGQAPRLLIYGASSRATGIPDRFSGSGSGTDFTLTISRLEPEDFAVYYCQQYGNSPWAFGQGTKVEIK

SEQ ID NO: 26627 - DNA, 324 bp, Artificial Sequence
  Description of Artificial Sequence: Synthetic polynucleotide
gaaattgtgttgacgcagtctccaggcaccctgtctttgtctccaggggaaagcgccaccctctcctgcagggccggtcaaagtattagaaccaacttcttagcctggtaccagcagcagcctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtagctcaccgtggacgttcggccaagggaccaaggtggaaatcaaa

SEQ ID NO: 26628 - protein, 108 aa, Artificial Sequence
  Description of Artificial Sequence: Synthetic polypeptide
EIVLTQSPGTLSLSPGESATLSCRAGQSIRTNFLAWYQQQPGQAPRLLIYGASSRATGIPDRFSGSGSGTDFTLTINRLEPEDFAVYYCQQYGSSPWTFGQGTKVEIK

SEQ ID NO: 26629 - DNA, 336 bp, Artificial Sequence
  Description of Artificial Sequence: Synthetic polynucleotide
gatattgtaatgacccagactccactctctctgtccgtcacccctggacagccggcctccatctcctgcaagtctagtcagagcctcctccatagtgatggaaggacctatttgtattggtacctgcagaagccaggccagcctccacagctcctgatctgtgaggtttccaaccggttcgctggagtgacagataggttcagtggcagcgggtcagggacagatttcacactgaaaatcagccgggtggaggctggggatgttggggtttattactgcatgcaaagtatacaacttccctggacgttcggccaagggaccaaggtggaaatcaaa

SEQ ID NO: 26630 - protein, 112 aa, Artificial Sequence
  Description of Artificial Sequence: Synthetic polypeptide
DIVMTQTPLSLSVTPGQPASISCKSSQSLLHSDGRTYLYWYLQKPGQPPQLLICEVSNRFAGVTDRFSGSGSGTDFTLKISRVEAGDVGVYYCMQSIQLPWTFGQGTKVEIK

SEQ ID NO: 26631 - DNA, 339 bp, Artificial Sequence
  Description of Artificial Sequence: Synthetic polynucleotide
gacatcgtgatgacccagtctccagactccctggctgtgtctctgggcgagagggccaccatcgactgtaagtccagccagagtgttttacacagctccaacagttacaactacttagcttggtaccagcagaaattaggacagcctcctaaactgctcatttactgggcatctacccgaaaatccggggtccctgaccgattcagtggcagcgggtctgggacagatttcactctcaccatcagcagcctgcaggctgaagatgtggcattttattactgtcagcaatattatagtagtcctcccactttcggccctgggaccaaaatggatatcaaa

SEQ ID NO: 26632 - protein, 113 aa, Artificial Sequence
  Description of Artificial Sequence: Synthetic polypeptide
DIVMTQSPDSLAVSLGERATIDCKSSQSVLHSSNSYNYLAWYQQKLGQPPKLLIYWASTRKSGVPDRFSGSGSGTDFTLTISSLQAEDVAFYYCQQYYSSPPTFGPGTKMDIK

SEQ ID NO: 26633 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaaagatttaggctggtatcagcagaaaccagggaaagcccctaagcgcctgatccatactgcatccagtttgcaaaatggggtcccattaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 26634 - protein, 107 aa, Artificial Sequence
  Description of Artificial Sequence: Synthetic polypeptide
DIQMTQSPSSLSASVGDRVTITCRASQGIRKDLGWYQQKPGKAPKRLIHTASSLQNGVPLRFSGSGSGTEFTLTISSLQPEDFATYYCLQHNSYPWTFGQGTKVEIK

SEQ ID NO: 26635 - DNA, 321 bp, Artificial Sequence; identical to SEQ ID NO: 26601
  Description of Artificial Sequence: Synthetic polynucleotide

SEQ ID NO: 26636 - protein, 107 aa, Artificial Sequence; identical to SEQ ID NO: 26602
  Description of Artificial Sequence: Synthetic polypeptide

SEQ ID NO: 26637 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggggattggcaatcatttagcctggtttcagcagaaaccagggaaagcccctaagtccctgatccatgctgcatccagtttgcaaagtggggtcccatcaaagttcagcggcagtggatctgggacagatttcactctcaccatcagcagcctgcagcctgaagattttgcaacttattactgccaacagtatagtaattacccagtcactttcggccctgggaccaaagtggatatcaaa

SEQ ID NO: 26638 - protein, 107 aa, Artificial Sequence
  Description of Artificial Sequence: Synthetic polypeptide
DIQMTQSPSSLSASVGDRVTITCRASQGIGNHLAWFQQKPGKAPKSLIHAASSLQSGVPSKFSGSGSGTDFTLTISSLQPEDFATYYCQQYSNYPVTFGPGTKVDIK

SEQ ID NO: 26639 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccaatcagagcattggtagtagcttacactggtaccagcagaaaccagatcagtctccaaagctcctcatcaagtatgcttcccagtccctctcaggggtcccctcgaggttcagtgccagtggatctgggacagatttcaccctcaccatcaatagcctggatgctgaagatgctgcaacgtattactgtcatcagactggtaggttacctctcactttcggcggagggaccaaggtggagatcaaa

SEQ ID NO: 26640 - protein, 107 aa, Artificial Sequence
  Description of Artificial Sequence: Synthetic polypeptide
EIVLTQSPDFQSVTPKEKVTITCRANQSIGSSLHWYQQKPDQSPKLLIKYASQSLSGVPSRFSASGSGTDFTLTINSLDAEDAATYYCHQTGRLPLTFGGGTKVEIK

SEQ ID NO: 26641 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcaggttcttagcctggtaccagcagaaacctggccaggctcccaggctcctcatctatggtgcttccaacagggccactggcatccccgacaggttcagtggcagtgggtctgggacagacttcactctcaccatcagcagactggagcctgaagattttgcagtgtattactgtcagcagtatggtggttcacctccgtggacgttcgtccaagggaccaaggtggaaatcaaa

SEQ ID NO: 26642 - protein, 109 aa, Artificial Sequence
  Description of Artificial Sequence: Synthetic polypeptide
EIVLTQSPGTLSLSPGERATLSCRASQSVSSRFLAWYQQKPGQAPRLLIYGASNRATGIPDRFSGSGSGTDFTLTISRLEPEDFAVYYCQQYGGSPPWTFVQGTKVEIK

SEQ ID NO: 26643 - DNA, 321 bp, Artificial Sequence
  Description of Artificial Sequence: Synthetic polynucleotide
gaaattgtgctgactcagtttccagactctcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagtctggaggctgaagatgctgcaacgtattactgtcatcagagtagtagtttccctcggacgttcggccaagggaccaaggtggaaatcaaa

SEQ ID NO: 26644 - protein, 107 aa, Artificial Sequence
  Description of Artificial Sequence: Synthetic polypeptide
EIVLTQFPDSQSVTPKEKVTITCRASQSIGSSLHWYQQKPDQSPKLLIKYASQSFSGVPSRFSGSGSGTDFTLTINSLEAEDAATYYCHQSSSFPRTFGQGTKVEIK

SEQ ID NO: 26645 - DNA, 321 bp, Artificial Sequence
  Description of Artificial Sequence: Synthetic polynucleotide
gacatccagatgacccagtctccatcctcactgtctgcatctgttggagacagagtcaccatcacttgtcgggcgagtcagggcattagaaattatttagcctggtttcagcagaaaccagggaaagcccctaagtccctgatctatgttgcatccagtttggaaagtggggtcccatcaaagttcagtggcagtggatctgggacagagttcactctcaccatcagcagcctgcaacctgaagattttggaacttattactgccaacagtatcttaattacccagtcactttcggccctgggaccaaagtggatatcaga

SEQ ID NO: 26646 - protein, 107 aa, Artificial Sequence
  Description of Artificial Sequence: Synthetic polypeptide
DIQMTQSPSSLSASVGDRVTITCRASQGIRNYLAWFQQKPGKAPKSLIYVASSLESGVPSKFSGSGSGTEFTLTISSLQPEDFGTYYCQQYLNYPVTFGPGTKVDIR

SEQ ID NO: 26647 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctccatagtgatggaaggacctatttgtattggtacctgcagaagccaggccagcctccacagctcctgatctgtgaggtttccaaccggttcgctggagtgacagataggttcagtggcagcgggtcagggacagatttcacactgaaaatcagccgggtggaggctggggatgttgggatttattactgcatgcaaagtatacattttccctggacgttcggccaagggaccaaggtggaaatcaaa

SEQ ID NO: 26648 - protein, 112 aa, Artificial Sequence
  Description of Artificial Sequence: Synthetic polypeptide
DIVMTQTPLSLSVTPGQPASISCKSSQSLLHSDGRTYLYWYLQKPGQPPQLLICEVSNRFAGVTDRFSGSGSGTDFTLKISRVEAGDVGIYYCMQSIHFPWTFGQGTKVEIK

SEQ ID NO: 26649 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattggcagatatttagcctggtttcagcagaagccagggaaagcccctaagtccctgatctatgctgcatccagtttgcaaagtggggtcccatcaaagttcagcggcagtggatctgggacagatttcactctcaccatcagcagcctgcagcctgaaaattttgcaacttattactgccaacaatatagtacttacccgctcactttcggcggagggaccaaggtggagatcaaa

SEQ ID NO: 26650 - protein, 107 aa, Artificial Sequence
  Description of Artificial Sequence: Synthetic polypeptide
DIQMTQSPSSLSASVGDRVTITCRASQDIGRYLAWFQQKPGKAPKSLIYAASSLQSGVPSKFSGSGSGTDFTLTISSLQPENFATYYCQQYSTYPLTFGGGTKVEIK

SEQ ID NO: 26651 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattaacaactggttagcctggtatcagcagaaaccagggaaagcccctaagctcctgatctatggtgtttccagtttgcagagtggggtcccatcaaggttcagcggcagtggatctgggacagatttcactctcaccatcagcagcctgcagcctgaagattttgcaacttactcttgtcaacaggctaacagtttcccgtggacgttcggccaagggaccaaggtggaaatcaga

SEQ ID NO: 26652 - protein, 107 aa, Artificial Sequence
  Description of Artificial Sequence: Synthetic polypeptide
DIQMTQSPSSVSASVGDRVTITCRASQGINNWLAWYQQKPGKAPKLLIYGVSSLQSGVPSRFSGSGSGTDFTLTISSLQPEDFATYSCQQANSFPWTFGQGTKVEIR

SEQ ID NO: 26653 - DNA, 321 bp, Artificial Sequence
  Description of Artificial Sequence: Synthetic polynucleotide
gacatccagatgacccagtctccatcctcacggtctgcatctataggagagagagtcaccatcacttgtcgggcgagtcagggcattagcaattatttagcctggattcagcagaaaccagggacagcccctaagtcccttatttatgctgcatccagtttgcaaagtggggtttcatcaaggtttagcggcagtggatttgggacagatttcactatcaccatcagtagtgtgcagcgtgaagattttgcaacttattactgccaacagtataatggttacccattcactttcggccatgggaccaaagtggatatcaaa

SEQ ID NO: 26654 - protein, 107 aa, Artificial Sequence
  Description of Artificial Sequence: Synthetic polypeptide
DIQMTQSPSSRSASIGERVTITCRASQGISNYLAWIQQKPGTAPKSLIYAASSLQSGVSSRFSGSGFGTDFTITISSVQREDFATYYCQQYNGYPFTFGHGTKVDIK

SEQ ID NO: 26655 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatattgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 26656 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYIASSLQSGVPSRFSGSGSGTEFTLTISSLQPEDFATYYCLQHNSYPFTFGPGTKVDIK

SEQ ID NO: 26657 - DNA, 321 bp, Artificial Sequence; identical to SEQ ID NO: 26655
  Description of Artificial Sequence: Synthetic polynucleotide

SEQ ID NO: 26658 - protein, 107 aa, Artificial Sequence; identical to SEQ ID NO: 26656
  Description of Artificial Sequence: Synthetic polypeptide

SEQ ID NO: 26659 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagacaccagggaaagcccctaagtccctgatctctgttgcatccagtttgcaaagtggggtcccatcaagattcagcgccagtggatctgggacagatttcactctcaccatcagcagcctgcagcctgaagattttgcaacttattactgccgacaatatcatagttacccattcactttcggccctgggaccaaagtggatatcaaa

SEQ ID NO: 26660 - protein, 107 aa, Artificial Sequence
  Description of Artificial Sequence: Synthetic polypeptide
DIQMTQSPSSLSASVGDRVTITCRASQGISNYLAWFQQTPGKAPKSLISVASSLQSGVPSRFSASGSGTDFTLTISSLQPEDFATYYCRQYHSYPFTFGPGTKVDIK

SEQ ID NO: 26661 - DNA, 321 bp, Artificial Sequence
  Description of Artificial Sequence: Synthetic polynucleotide
gacatccagatgacccagtctccatcctcacggtctgcatctataggagagagagtcaccatcacttgtcgggcgagtcagggcattagcaattatttagcctggattcagcagaaaccagggacagcccctaagtcccttatctatgctgcatccagtttgcaaagtggggtttcatcaaggtttagcggcagtggatttgggacagatttcactctcaccatcagtagtctgcagcctgaagattttgcaacttattactgccaacagtataatggttacccattcactttcggccctgggaccaaagtggatatcaaa

SEQ ID NO: 26662 - protein, 107 aa, Artificial Sequence
  Description of Artificial Sequence: Synthetic polypeptide
DIQMTQSPSSRSASIGERVTITCRASQGISNYLAWIQQKPGTAPKSLIYAASSLQSGVSSRFSGSGFGTDFTLTISSLQPEDFATYYCQQYNGYPFTFGPGTKVDIK

SEQ ID NO: 26663 - DNA, 336 bp, Artificial Sequence
  Description of Artificial Sequence: Synthetic polynucleotide
gatgttgtgatggcccagactccactctctctgtccgtcacccctggacagccggcctccatctcctgcaagtctagtcagagcctcctgcatggtgatggaaagacctatttgtgttggtacctccagaagccaggccagcctccacagctcctgatctatgaagtttccaagcggttctctggagtgccagataggttcagtggcagcgggtcagggacagatttcacactgaaaatcagccgggtggaggctgaggatgttggggtctattactgcatgcaaagtatacaggttccctggacgttcggccaagggaccaaggtggaaatcaaa

SEQ ID NO: 26664 - protein, 112 aa, Artificial Sequence
  Description of Artificial Sequence: Synthetic polypeptide
DVVMAQTPLSLSVTPGQPASISCKSSQSLLHGDGKTYLCWYLQKPGQPPQLLIYEVSKRFSGVPDRFSGSGSGTDFTLKISRVEAEDVGVYYCMQSIQVPWTFGQGTKVEIK

SEQ ID NO: 26665 - DNA, 321 bp, Artificial Sequence
  Description of Artificial Sequence: Synthetic polynucleotide
gacatccagatgacccagtctccatcttccgtgtctgcatctgttggagacagagtcaccatcacttgtcgggcgagtcaggatattaccagctggttagcctggtatcagcagaaaccagggaaagcccctaaactcctgatctatgctgcatccagtttacaaagtggggtcccatcaaggttcagcggcagtggatctgggacagatttcattctcaccatcaccagcgtgcagcctgatgattttgcaacttactattgtcaacaggttaacagtttcccattcactttcggccatgggaccaaagtggatatcaaa

SEQ ID NO: 26666 - protein, 107 aa, Artificial Sequence
  Description of Artificial Sequence: Synthetic polypeptide
DIQMTQSPSSVSASVGDRVTITCRASQDITSWLAWYQQKPGKAPKLLIYAASSLQSGVPSRFSGSGSGTDFILTITSVQPDDFATYYCQQVNSFPFTFGHGTKVDIK

SEQ ID NO: 26667 - DNA, 321 bp, Artificial Sequence
  Description of Artificial Sequence: Synthetic polynucleotide
gacatccagatgacccagtctccatcctcactgtctgcatctataggagagagagtcaccatcacttgtcgggcgagtcagggcattagcaattatttagcctggcttcagcagaaaccagggacagcccctaagtccctgatctatgctgcttccagtttgcaaagtggggtctcatcaaggttcagcggcagtggatttgggacagatttcactctcaccatcagtagtctgcagcctgaagattttgcaacttattactgccaacagtataatagttatccattcactttcggccctgggaccaaagtggatatcaaa

SEQ ID NO: 26668 - protein, 107 aa, Artificial Sequence
  Description of Artificial Sequence: Synthetic polypeptide
DIQMTQSPSSLSASIGERVTITCRASQGISNYLAWLQQKPGTAPKSLIYAASSLQSGVSSRFSGSGFGTDFTLTISSLQPEDFATYYCQQYNSYPFTFGPGTKVDIK

SEQ ID NO: 26669 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgaatcaggatatttccagctggttagcctggtatcagcagaaaccagggaaagcccctaagctcctgatctatgctgcatccaatttgcaaagtggggtcccatcagggttcagcggcagtggatctgggacagatttcactctcaccatcagcagcctgcagcctgaagattttgcaacttactattgtcagcaggctaacagtttcccgtggacgttcggccaagggaccaaggtggaaatcaag

SEQ ID NO: 26670 - protein, 107 aa, Artificial Sequence
  Description of Artificial Sequence: Synthetic polypeptide
DIQMTQSPSSVSASVGDRVTITCRANQDISSWLAWYQQKPGKAPKLLIYAASNLQSGVPSGFSGSGSGTDFTLTISSLQPEDFATYYCQQANSFPWTFGQGTKVEIK

SEQ ID NO: 26671 - DNA, 321 bp, Artificial Sequence
  Description of Artificial Sequence: Synthetic polynucleotide
gacatccagatgacccagtctccatcctcactgtctgcatctataggagagagagtcaccatcacttgtcgggcgagtcagggcattagcaattatttagcctggcttcagcagaaaccagggacagcccctaagtccctgatctatgctgcatccagtttgcaaagtggggtctcatcaaggttcagcggcagtggatttgggacagatttcactctcaccatcagtagtctgcagcctgaagattttgcaacttattactgccaacagtataatagttacccattcactttcggccctgggaccaaagtggatatcaaa

SEQ ID NO: 26672 - protein, 107 aa, Artificial Sequence; identical to SEQ ID NO: 26668
  Description of Artificial Sequence: Synthetic polypeptide

SEQ ID NO: 26673 - DNA, 336 bp, Artificial Sequence
  Description of Artificial Sequence: Synthetic polynucleotide
gatattgtgatgacccagactccactctctctgtccgtcacccctggacagccggcctccatctcctgcatgtctagtcagagcctcctgcatggtgatggaaagacctatttatattggtacctgcagaagcccggccagcctccacagctcctgatctatgaagtttccaaccggttctctggagtgccagatacgttcagtggcagcgggtcagggacagatttcacactgaaaatcagccgggtggaggctgaggatgttggggtttattactgcatgcaaagtatacagattccttggacgttcggccaagggaccaaggtggaaatcaaa

SEQ ID NO: 26674 - protein, 112 aa, Artificial Sequence
  Description of Artificial Sequence: Synthetic polypeptide
DIVMTQTPLSLSVTPGQPASISCMSSQSLLHGDGKTYLYWYLQKPGQPPQLLIYEVSNRFSGVPDTFSGSGSGTDFTLKISRVEAEDVGVYYCMQSIQIPWTFGQGTKVEIK

SEQ ID NO: 26675 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgttttggtacctgcagaagccaggccagcctccacaactcctgatctatgaagtttccaaccggttctctggagtgtcagataggttcagtggcagcgggtcagggacagatttcacactgaaaatcagccgggtggaggctgaggatgttggggtttactactgcatgcaaagtatacagattccgtggacgttcggccaagggaccaaggtggagatcaaa

SEQ ID NO: 26676 - protein, 112 aa, Artificial Sequence
  Description of Artificial Sequence: Synthetic polypeptide
DIVMTQTPLSLSVTPGQPASISCKSSQSLLHGDGKTYLFWYLQKPGQPPQLLIYEVSNRFSGVSDRFSGSGSGTDFTLKISRVEAEDVGVYYCMQSIQIPWTFGQGTKVEIK

SEQ ID NO: 26677 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcaactccaacaataagaactacttagcttggtaccagcagaaaccaggtcagcctcctaacctgctcatttactgggcatctacccgggaatccggggtccctgaccgattcagtggcagcgggtctgggacagatttcactctcaccatcagcagcatgcaggctgaagatgtggcagtttattactgtcagcaatattgtagtcttccattcactttcggccctgggaccaaagtggatatcaga

SEQ ID NO: 26678 - protein, 113 aa, Artificial Sequence
  Description of Artificial Sequence: Synthetic polypeptide
DIVMTQSPDSLAVSLGERATINCKSSQSVLFNSNNKNYLAWYQQKPGQPPNLLIYWASTRESGVPDRFSGSGSGTDFTLTISSMQAEDVAVYYCQQYCSLPFTFGPGTKVDIR

SEQ ID NO: 26679 - DNA, 324 bp, Artificial Sequence
  Description of Artificial Sequence: Synthetic polynucleotide
gaaattatgttgacgcagtctccaggcaccctgtctttgtctccaggggaaagagccaccctctcctgcagggccagtcagaatataaggagcaacttcttagcctggtaccagcagaaacctggccaggctcccaggctcctcatctatggtgcatccagcagggccactggcatcccagacagattcagtggcagtgtgtctgggacagacttcactctcaccatcaacagactggagcctgaagattttgcggtgtattactgtcagcagtatggtaactcaccgtggacgttcggccaagggaccaaggtggaaatcaaa

SEQ ID NO: 26680 - protein, 108 aa, Artificial Sequence
  Description of Artificial Sequence: Synthetic polypeptide
EIMLTQSPGTLSLSPGERATLSCRASQNIRSNFLAWYQQKPGQAPRLLIYGASSRATGIPDRFSGSVSGTDFTLTINRLEPEDFAVYYCQQYGNSPWTFGQGTKVEIK

SEQ ID NO: 26681 - DNA, 321 bp, Artificial Sequence
  Description of Artificial Sequence: Synthetic polynucleotide
gacatccagatgacccagtctccatcctccctgtctgcatctgtaagagacagagtcaccatcacttgccgggcaagtcagggcattagaaaagatttaggctggtatcagcagaaaccagggaaagcccctaagcgcctgatccatactgcatccagtttgcaaagtggggtcccattaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 26682 - protein, 107 aa, Artificial Sequence
  Description of Artificial Sequence: Synthetic polypeptide
DIQMTQSPSSLSASVRDRVTITCRASQGIRKDLGWYQQKPGKAPKRLIHTASSLQSGVPLRFSGSGSGTEFTLTISSLQPEDFATYYCLQHNSYPWTFGQGTKVEIK

SEQ ID NO: 26683 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtcttaacaactggttagcctggtatcagctgaaaccagggaaagcccctaagctcctgatctatgctgtgtccagtttgcaaagtggggtcccatcaaggttcagcggcagtggatctgggtcagagttcactctcaccatcagcagcctgcagcctgaagattttgcaacttaccattgtcaacaggctaacagtctcccgtggacgttcggccaagggaccaaggtggaaatcaaa

SEQ ID NO: 26684 - protein, 107 aa, Artificial Sequence
  Description of Artificial Sequence: Synthetic polypeptide
DIQMTQSPSSVSASVGDRVTITCRASQGLNNWLAWYQLKPGKAPKLLIYAVSSLQSGVPSRFSGSGSGSEFTLTISSLQPEDFATYHCQQANSLPWTFGQGTKVEIK

SEQ ID NO: 26685 - DNA, 324 bp, Artificial Sequence
  Description of Artificial Sequence: Synthetic polynucleotide
gaaattgtgttgacgcagtctccaggcaccctgtctttgtctccaggggaaagagccacactctcctgcagggccagtcagagtattcgcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtaactcaccgtgggcgttcggccaagggaccaaggtggaaatcaaa

SEQ ID NO: 26686 - protein, 108 aa, Artificial Sequence; identical to SEQ ID NO: 26626
  Description of Artificial Sequence: Synthetic polypeptide

SEQ ID NO: 26687 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagaagcaacttcttagcctggcaccagcagaaacctggccaggctcccaggctcctcatctatggtgcataccgcagggccactggcatcccagacaggttcagtggcagtgggtctgggacagacttcactctcaccatcaacagactggagcctgaagattttgcagtgtattactgtcagcagtatggtaactcaccgtggacgttcggccaagggaccaaggtggaaatcaaa

SEQ ID NO: 26688 - protein, 108 aa, Artificial Sequence
  Description of Artificial Sequence: Synthetic polypeptide
EIVLTQSPGTLSLSPGERATLSCRASQSVRSNFLAWHQQKPGQAPRLLIYGAYRRATGIPDRFSGSGSGTDFTLTINRLEPEDFAVYYCQQYGNSPWTFGQGTKVEIK

SEQ ID NO: 26689 - DNA, 339 bp, Artificial Sequence
  Description of Artificial Sequence: Synthetic polynucleotide
gccaacgtgatgacccagtctccagactccctggctgtgtctctgggcgagaggaccaccatcaactgcaagtccagccagagtgttttacacagctccaacaattacaactacttagcttggtaccggcagaaaccaggacagcctcctaagctgctcatttactgggcatctacccgggaatccggggtccctgaccgattcagtggcagcgggtctggtacagatttcactctcaccatcagcagcctgcaggctgaagatgtggcagtttattactgtcagcaatattatagtattcctcccactttcggccctgggaccaaagtggatatcaaa

SEQ ID NO: 26690 - protein, 113 aa, Artificial Sequence
  Description of Artificial Sequence: Synthetic polypeptide
ANVMTQSPDSLAVSLGERTTINCKSSQSVLHSSNNYNYLAWYRQKPGQPPKLLIYWASTRESGVPDRFSGSGSGTDFTLTISSLQAEDVAVYYCQQYYSIPPTFGPGTKVDIK

SEQ ID NO: 26691 - DNA, 321 bp, Artificial Sequence
  Description of Artificial Sequence: Synthetic polynucleotide
gaaattgtgctgactcagtctccagactttcagtctgtggctccaaaggagaaagtcaccatcacctgccgggccagtcagagtattggtagtaacttacactggtaccagcagaaacctgatcagtctccaaagctcctcatcaagtctgcttcccagtccttctcaggggtcccctcgaggttcagtggcagtggatctgggacagatttcaccctcaccatcaatagcctggaaactgaagatgctgcaacgtattactgtcagcagagtagtagtttaccgtggacgttcggccaagggaccaaggtggaaatcaaa

SEQ ID NO: 26692 - protein, 107 aa, Artificial Sequence; identical to SEQ ID NO: 26594
  Description of Artificial Sequence: Synthetic polypeptide

SEQ ID NO: 26693 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaaagatttaggctggtatcagcagaaaccagggaaagcccctaagcgcctgatccatactgcatccagtttgcaaagtggggtcccattaaggttcagcggcagtggatctgggacagaattcactctcacaatcagcagcctgcagcctgaagattttgcaacttattactgtctacagcataataattacccgtggacgttcggccaagggaccaaggtggaaatcaaa

SEQ ID NO: 26694 - protein, 107 aa, Artificial Sequence
  Description of Artificial Sequence: Synthetic polypeptide
DIQMTQSPSSLSASVGDRVTITCRASQGIRKDLGWYQQKPGKAPKRLIHTASSLQSGVPLRFSGSGSGTEFTLTISSLQPEDFATYYCLQHNNYPWTFGQGTKVEIK

SEQ ID NO: 26695 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagctgaaaccagggaaagcccctaagcgcctgatttatgctgcatccagtttgcaaagtggggtcccatcaaggttcagcggcagtggatctgggccagaattcactctcacaatcagcagcctgcagcctgaagattttgcaacttattactgtctacagcattatagtttcccattcactttcggccctgggaccaaagtggatatcaaa

SEQ ID NO: 26696 - protein, 107 aa, Artificial Sequence
  Description of Artificial Sequence: Synthetic polypeptide
DIQMTQSPSSLSASVGDRVTITCRASQGIRNDLGWYQLKPGKAPKRLIYAASSLQSGVPSRFSGSGSGPEFTLTISSLQPEDFATYYCLQHYSFPFTFGPGTKVDIK

SEQ ID NO: 26697 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcaactccaacaataagaactacttagcttggtaccagcagaaaccaggtcagcctcctaacctgctcatttactgggcatctacccgggaatccggggtccctgaccgattcagtggcagcgggtgtgggacagatttcactctcaccatcagcagcctgcaggctgaagatgtggcagtttattactgtcagcaatattgtagtcttccattcactttcggccctgggaccaaagtggatatcaga

SEQ ID NO: 26698 - protein, 113 aa, Artificial Sequence
  Description of Artificial Sequence: Synthetic polypeptide
DIVMTQSPDSLAVSLGERATINCKSSQSVLFNSNNKNYLAWYQQKPGQPPNLLIYWASTRESGVPDRFSGSGCGTDFTLTISSLQAEDVAVYYCQQYCSLPFTFGPGTKVDIR

SEQ ID NO: 26699 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatccagctccaacaattacaactatttagtttggtatcagcagaaaccaggacagcctcctaagctgctcatttactgggcatctacccggaaatccggggtccctgaccgattcagtggcagcgggtctgggacagattttactctcaccatcagcagcctgcaggctgatgacgtggcagtttattactgtcaacaatattatcgtactccgtggacgttcggccaagggaccaaggtggagatcaaa

SEQ ID NO: 26700 - protein, 113 aa, Artificial Sequence
  Description of Artificial Sequence: Synthetic polypeptide
DIVMTQSPDSLAVSLGERATINCKSSQSVLSSSNNYNYLVWYQQKPGQPPKLLIYWASTRKSGVPDRFSGSGSGTDFTLTISSLQADDVAVYYCQQYYRTPWTFGQGTKVEIK

SEQ ID NO: 26701 - DNA, 336 bp, Artificial Sequence
  Description of Artificial Sequence: Synthetic polynucleotide
gatattgtgttgacccagactccactctctctgtccgtcacccctggacagccggcctccatctcctgcaagtctagtcagagcctcctccatagtgatggaaggacctatttgtattggtacctgcagaaaccaggccagcctccacaggtcctgatctgtgaggtttccaaccggttctctggagtgccagataggttcagtggcagcgggtcagggacagatttcacactgaaaatcagccgggtggaggctggagatgttggggtttattactgcatgcaaagtatacagcttccctggacgttcggccaagggaccaaggtggaaatcaaa

SEQ ID NO: 26702 - protein, 112 aa, Artificial Sequence
  Description of Artificial Sequence: Synthetic polypeptide
DIVLTQTPLSLSVTPGQPASISCKSSQSLLHSDGRTYLYWYLQKPGQPPQVLICEVSNRFSGVPDRFSGSGSGTDFTLKISRVEAGDVGVYYCMQSIQLPWTFGQGTKVEIK

SEQ ID NO: 26703 - DNA, 321 bp, Artificial Sequence
  Description of Artificial Sequence: Synthetic polynucleotide
gaaattgtgctgactcagtttccagactctcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacatattactgtcatcagagtagtagtttccctcggacgttcggccaagggaccaaggtggaaatcaaa

SEQ ID NO: 26704 - protein, 107 aa, Artificial Sequence; identical to SEQ ID NO: 26644
  Description of Artificial Sequence: Synthetic polypeptide

SEQ ID NO: 26705 - DNA, 321 bp, Artificial Sequence
  Description of Artificial Sequence: Synthetic polynucleotide
gacatccagatgacccagtctccttcctcactgtctgcatctgtaggagacagagtcaccatcacttgtcggacgagtcagggcattggcaattatttagcctggtttcagcagaaaccagggaaagcccctaagtccctactctataaagcatccagtttacaaagtggggtcccatcaaagttcagcggcagtggatctgggacagatttcactctcaccatcagcagcctgcagcctgaagattttgcaacttattactgccaacagtatatgacttacccactcactttcggcggagggaccaaggtggagatcaaa

SEQ ID NO: 26706 - protein, 107 aa, Artificial Sequence; identical to SEQ ID NO: 26602
  Description of Artificial Sequence: Synthetic polypeptide

SEQ ID NO: 26707 - DNA, 321 bp, Artificial Sequence
  Description of Artificial Sequence: Synthetic polynucleotide
gaaattgtgctgactcagtttccagactctcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtagtttccctcggacgttcggccaagggaccaaggtggaaatcaaa

SEQ ID NO: 26708 - protein, 107 aa, Artificial Sequence; identical to SEQ ID NO: 26644
  Description of Artificial Sequence: Synthetic polypeptide

SEQ ID NO: 26709 - DNA, 321 bp, Artificial Sequence
  Description of Artificial Sequence: Synthetic polynucleotide
gacatccagatgacccagtctccatcctcactgtctgcatctgtgggagacagagtcaccatcacttgtcgggcgagtcagggcattggcaagtatttagcctggtttcagcagaaaccagggaaagcccttaagtcactgatctatgctgcatccagtttgcaaagtggggtcccatcaaaattcagcggcagtggatctgggacagatttcactctcaccatcagcagcctgcagcctgacgattttgcaacttattactgccaacgatatgatacttacccattcactttcggccctgggaccaaagtggatatcaaa

SEQ ID NO: 26710 - protein, 107 aa, Artificial Sequence
  Description of Artificial Sequence: Synthetic polypeptide
DIQMTQSPSSLSASVGDRVTITCRASQGIGKYLAWFQQKPGKALKSLIYAASSLQSGVPSKFSGSGSGTDFTLTISSLQPDDFATYYCQRYDTYPFTFGPGTKVDIK

SEQ ID NO: 26711 - DNA, 324 bp, Artificial Sequence
  Description of Artificial Sequence: Synthetic polynucleotide
gaaattgtgttgacgcagtctccaggcaccctgtctttgtctccaggggaaagcgccaccctctcctgcagggccggtcaaagtattagaaccgacttcttagcctggtaccagcagcaacctggccaggctcccaggctcctcatctatggtccatccagcagggccactggcatcccagacaggttcagtggcagtgggtctgggacagacttcactctcaccatcaacagactggagcctgaagattttgcagtgtatttctgtcagcagtatggtagctcaccgtggacgttcggccaagggaccaaggtggaaatcaat

SEQ ID NO: 26712 - protein, 108 aa, Artificial Sequence
  Description of Artificial Sequence: Synthetic polypeptide
EIVLTQSPGTLSLSPGESATLSCRAGQSIRTDFLAWYQQQPGQAPRLLIYGPSSRATGIPDRFSGSGSGTDFTLTINRLEPEDFAVYFCQQYGSSPWTFGQGTKVEIN

SEQ ID NO: 26713 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcaggcccagtcagagttttagcagaaacttagcctggtaccagcagaaacctggccaggctcccaggctcctcatctatggtgcatccactagggccactggtatcccatccaggttcagtggcagtgggtctgggacagagttcactctcaccatcagcagcctggagtctgaagattttgcagtttactactgtcagcagtataataactggccgctcactttcggcggagggatcaaggtggagatcaaa

SEQ ID NO: 26714 - protein, 107 aa, Artificial Sequence
  Description of Artificial Sequence: Synthetic polypeptide
EIVMTQSPATLSVSPGERATLSCRPSQSFSRNLAWYQQKPGQAPRLLIYGASTRATGIPSRFSGSGSGTEFTLTISSLESEDFAVYYCQQYNNWPLTFGGGIKVEIK

SEQ ID NO: 26715 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagtattggtagtagtttacactggtaccagcagaaaccagatcagtctccaaagctcctcatcaagtatgcttcccagtccttctcaggggacccctcgaggttcagtggcagtggatctgggacagatttcaccctcaccatcaatagcctggaagctgaagatgctgcaacgtattactgtcatcagactagaagtttacctctcactttcggcggagggaccaaggtggagatcaaa

SEQ ID NO: 26716 - protein, 107 aa, Artificial Sequence; identical to SEQ ID NO: 26606
  Description of Artificial Sequence: Synthetic polypeptide

SEQ ID NO: 26717 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaagtatttagcctggtttcagcagaaaccagggaaagcccctaagtccctgatctatgctgcatccagtttgcaaagtggggtcccatcaaagttcagcggcagtggatatgggacagatttcactctcaccatcagcagcctgcagcctgaaaattttgcaatttattactgccaacagtatagtacttacccgctcactttcggcggagggaccaaggtggagatcaaa

SEQ ID NO: 26718 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYAASSLQSGVPSKFSGSGYGTDFTLTISSLQPENFAIYYCQQYSTYPLTFGGGTKVEIK

SEQ ID NO: 26719 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaagtatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaaaattttgcaacttattactgccaacagtatagtacttacccgctcactttcggcggagggaccaaggtggagatcaaa

SEQ ID NO: 26720 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYAASSLQSGVPSKFSGSGSGTDFTLTISSLQPENFATYYCQQYSTYPLTFGGGTKVEIK

SEQ ID NO: 26721 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcaactccaacaataagaactacttagcttggtaccagcagaaaccaggtcagcctcctaaactgctcatttactgggcctctacccgggaatccggggtccctgaccgattcagtggcagcgggtctgggacagatttcactctcaccatcagcaacctgcaggctgaagatgtggcaatttattactgtcagcaatattctagtcttccattcactttcggccctgggaccaaagtggatatcaaa

SEQ ID NO: 26722 - protein, 113 aa, Artificial Sequence
  Description of Artificial Sequence: Synthetic polypeptide
DIVMTQSPDSLAVSLGERATINCKSSQSVLFNSNNKNYLAWYQQKPGQPPKLLIYWASTRESGVPDRFSGSGSGTDFTLTISNLQAEDVAIYYCQQYSSLPFTFGPGTKVDIK

SEQ ID NO: 26723 - DNA, 321 bp, Artificial Sequence
  Description of Artificial Sequence: Synthetic polynucleotide
gacatccagatgacccagtctccttcctcactgtctgcatctgtaggagacagagtcaccatcacttgtcggacgagtcagggcattggcaattatttagcctggtttcagcagaaaccagggaaagcccctaagtccctgctctataaagcatccagtttgcaaagtggggtcccatcaaagttcagcggcagtggatctgggacagatttcactctcaccatcagcagcctgcagcctgaagattttgcaacttattactgccaacagtatatcacttacccgctcactttcggcggagggtccaaggtggagatcaaa

SEQ ID NO: 26724 - protein, 107 aa, Artificial Sequence
  Description of Artificial Sequence: Synthetic polypeptide
DIQMTQSPSSLSASVGDRVTITCRTSQGIGNYLAWFQQKPGKAPKSLLYKASSLQSGVPSKFSGSGSGTDFTLTISSLQPEDFATYYCQQYITYPLTFGGGSKVEIK

SEQ ID NO: 26725 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgaatcagggcattaacaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccattcactttcggccctgggaccaaagtggatatcaaa

SEQ ID NO: 26726 - protein, 107 aa, Artificial Sequence
  Description of Artificial Sequence: Synthetic polypeptide
DIQMTQSPSSLSASVGDRVTITCRANQGINNYLAWFQQKPGKAPKSLIYAASSLQSGVPSKFSGSGSGTDFTLTISSLQPEDFATYYCQQYNSYPFTFGPGTKVDIK

SEQ ID NO: 26727 - DNA, 321 bp, Artificial Sequence
  Description of Artificial Sequence: Synthetic polynucleotide
gacatccagatgattcagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacattatgttacttacccgaacactttcggcggagggaccaaggtggagatcaaa

SEQ ID NO: 26728 - protein, 107 aa, Artificial Sequence
  Description of Artificial Sequence: Synthetic polypeptide
DIQMIQSPSSLSASVGDRVTITCRASQGISNYLAWFQQKPGKAPKSLIYAASSLQSGVPSKFSGSGSGTDFTLTISSLQPEDFATYYCQHYVTYPNTFGGGTKVEIK

SEQ ID NO: 26729 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtataagtagttggatagcctggtatcagcagaaaccagggaaagcccctaagctcctgatctatggtgcatccagtttgcaaagtggggtcccatctaggttcagcggcagtggatctgggacagatttcactctcaccatcagcagcctgcagcctgaagattttgcaacttactattgtcaacagtctaacagtttcccattcactttcggccctgggaccaaagtggatgtcaaa

SEQ ID NO: 26730 - protein, 107 aa, Artificial Sequence
  Description of Artificial Sequence: Synthetic polypeptide
DIQMTQSPSSVSASVGDRVTITCRASQGISSWIAWYQQKPGKAPKLLIYGASSLQSGVPSRFSGSGSGTDFTLTISSLQPEDFATYYCQQSNSFPFTFGPGTKVDVK

SEQ ID NO: 26731 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttcgcagcagcttccttgcctggtaccagcagaaacctggccaggctcccaggctcctcatctatggtgcatctagcagggccactggcatcccagacaggttcagtggcagtgggtctgggacagacttcactctcaccatcagcagactggagcctgaagattttgctgtgtattactgtcagcagtatggtaactcaccgtgggcgttcggccaagggaccaaggtggaaatcaaa

SEQ ID NO: 26732 - protein, 108 aa, Artificial Sequence
  Description of Artificial Sequence: Synthetic polypeptide
EIVLTQSPGTLSLSPGERATLSCRASQSVRSSFLAWYQQKPGQAPRLLIYGASSRATGIPDRFSGSGSGTDFTLTISRLEPEDFAVYYCQQYGNSPWAFGQGTKVEIK

SEQ ID NO: 26733 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctggaacagatttcactctcaccatcagcagcctgcagcctgaagattttgcaacttattactgcctacattatcttacttaccctctcactttcggcggagggaccaaggtggagatcaaa

SEQ ID NO: 26734 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCLHYLTYPLTFGGGTKVEIK

SEQ ID NO: 26735 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcaacttcttagcctggtaccagcagaaacctggccaggctcccaggctcctcatctttggtgcatccagcagggccactggcatcccagacaggttcagtggcagtgggtctgggacagacttcactctcaccatcaacagactggagcctgaagattttgcagtgtattactgtcagcaatatggtatctcaccgtggacgttcggccaagggaccaaggtggaaatcaaa

SEQ ID NO: 26736 - protein, 108 aa, Artificial Sequence
  Description of Artificial Sequence: Synthetic polypeptide
EIVLTQSPGTLSLSPGERATLSCRASQSVSSNFLAWYQQKPGQAPRLLIFGASSRATGIPDRFSGSGSGTDFTLTINRLEPEDFAVYYCQQYGISPWTFGQGTKVEIK

SEQ ID NO: 26737 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaattatttagcctggtttcagcagaaaccagggaaagcccctaagtccctgatctatgttgtatccagtttacaaagtggggtcccatcaaggttcagcggcagtggatctgggacagatttcactctcaccatcagcagcctgcagcctgaagattttgcgacttattactgccaacggtatgatacttacccattcactttcggccctgggaccaaagtggatatcaaa

SEQ ID NO: 26738 - protein, 107 aa, Artificial Sequence
  Description of Artificial Sequence: Synthetic polypeptide
DIQMTQSPSSLSASVGDRVTITCRASQGIGNYLAWFQQKPGKAPKSLIYVVSSLQSGVPSRFSGSGSGTDFTLTISSLQPEDFATYYCQRYDTYPFTFGPGTKVDIK

SEQ ID NO: 26739 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagcctggtttcagcagaaaccagggaaagcccctaagtccctgatctctgctgcatccagtttgcaaagtggggtcccatcaaagttcagcggcagtagatctgggacagatttcactctcaccatcagcagcctgcagcctgaagattttgcaacttattacggcctacattatctcaattacccgctcactttcggcggagggaccagggtggagatcaga

SEQ ID NO: 26740 - protein, 107 aa, Artificial Sequence
  Description of Artificial Sequence: Synthetic polypeptide
DIQMTQSPSSLSASVGDRVTITCRASQDISNYLAWFQQKPGKAPKSLISAASSLQSGVPSKFSGSRSGTDFTLTISSLQPEDFATYYGLHYLNYPLTFGGGTRVEIR

SEQ ID NO: 26741 - DNA, 321 bp, Artificial Sequence
  Description of Artificial Sequence: Synthetic polynucleotide
gaaattgttctgactcagtctccagattttcagtctgtgactccaaaggagaaagtcaccatcacctgccgggccagtcagagcattggtaggagtttacactggtaccagcagaaaccagatcagtctccaaagctcctcatcaagtatgcttcccagtcattctcaggggtcccctcgaggttcagtggcagtggatctgggacagatttcaccctcaccatcaatagcctggaggctgaagatgctgcaacgtattactgtcatcagagtagtcgtttaccgctcactttcggcggagggaccaaggtggagatcaaa

SEQ ID NO: 26742 - protein, 107 aa, Artificial Sequence
  Description of Artificial Sequence: Synthetic polypeptide
EIVLTQSPDFQSVTPKEKVTITCRASQSIGRSLHWYQQKPDQSPKLLIKYASQSFSGVPSRFSGSGSGTDFTLTINSLEAEDAATYYCHQSSRLPLTFGGGTKVEIK

SEQ ID NO: 26743 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagctgaaaccagggaaagcccctaagcgcctgatctatgctgcatccagtttgcaaagtggggtcccatcaaggttcagcggcagtggatctgggccagaattcactctcacaatcagcagcctgcagcctgaagattttgcaacttattactgtctacagcattatagtttcccattcactttcggccctgggaccaaagtggatatcaaa

SEQ ID NO: 26744 - protein, 107 aa, Artificial Sequence; identical to SEQ ID NO: 26696
  Description of Artificial Sequence: Synthetic polypeptide

SEQ ID NO: 26745 - DNA, 321 bp, Artificial Sequence
  Description of Artificial Sequence: Synthetic polynucleotide
gacatcaagatgacccagtctccttcctcactgtctgcatctgtaggagacagagtcaccatcacttgtcggacgagtcagggcattggcaattatttagcctggtttcagcagaaaccagggaaagcccctaagtccctgctctataaagcatccagtttgcaaagtggggtcccatcaaagttcagcggcagtggatctgggacagatttcactctcaccatcagcagcctgcagcctgaagattttgcaacttattactgccaacagtatatgacttacccgctcactttcggcggggggaccaaggtggagatcaaa

SEQ ID NO: 26746 - protein, 107 aa, Artificial Sequence
  Description of Artificial Sequence: Synthetic polypeptide
DIKMTQSPSSLSASVGDRVTITCRTSQGIGNYLAWFQQKPGKAPKSLLYKASSLQSGVPSKFSGSGSGTDFTLTISSLQPEDFATYYCQQYMTYPLTFGGGTKVEIK

SEQ ID NO: 26747 - DNA, 321 bp, Artificial Sequence
  Description of Artificial Sequence: Synthetic polynucleotide
gacatccagatgacccagtctccatcctccctgtctgcgtctgtaggagacagagtcaccatcacttgccgggcaagtcagggcattagaaaagatttaggctggtatcaacagaaaccagggaaagcccctaagcgcctaatccatactgcatccagtttgcaaagtggggtcccattaaggttcagcggcagtggatctgggacagaattcactctcacaatcagcagcctgcagcctgaagattttgcaacttattactgtctacagcatactagttacccgtggacgttcggccaagggaccaaggtggaaatctac

SEQ ID NO: 26748 - protein, 107 aa, Artificial Sequence
  Description of Artificial Sequence: Synthetic polypeptide
DIQMTQSPSSLSASVGDRVTITCRASQGIRKDLGWYQQKPGKAPKRLIHTASSLQSGVPLRFSGSGSGTEFTLTISSLQPEDFATYYCLQHTSYPWTFGQGTKVEIY

SEQ ID NO: 26749 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctggaacagatttcactctcaccatcagcagcctgcagcctgaggattttgctacttattactgccaacattatcttacttaccctctcactttcggcggagggaccaaggtggagatcaaa

SEQ ID NO: 26750 - protein, 107 aa, Artificial Sequence; identical to SEQ ID NO: 26622
  Description of Artificial Sequence: Synthetic polypeptide

SEQ ID NO: 26751 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagcagcagctacttagcctggtaccagcagaaacctggccaggctccccggctcctcatctatggtgcatccagcagggccactggcatcccagccaggttcagtggcagtgggtctgggacagacttcactctcaccatcagcagactggagcctgaagattttgcagtgtattactgtcagcagtatgagagttcaccgtggacgttcggccaagggaccaaggtggaaatcaaa

SEQ ID NO: 26752 - protein, 108 aa, Artificial Sequence
  Description of Artificial Sequence: Synthetic polypeptide
EIVLTQSPGTLSLSPGERATLSCRASQSISSSYLAWYQQKPGQAPRLLIYGASSRATGIPARFSGSGSGTDFTLTISRLEPEDFAVYYCQQYESSPWTFGQGTKVEIK

SEQ ID NO: 26753 - DNA, 321 bp, Artificial Sequence
  Description of Artificial Sequence: Synthetic polynucleotide
gacatccagatgacccagtctccttcctcactgtctgcatctgtaggagacagagtcaccatcacttgtcggacgagtcagggcattggcaattatttagcctggtttcagcagaaaccagggaaagcccctaagtccctgctctataaagcatccagtttgcaaagtggggtcccatcaaagttcagcggcagtggatctgggacagatttcactctcaccatcagcagcctgcagcctgaagattttgcaacttattactgccaacagtatatcacttacccgctcactttcggcggagggaccaaggtggagatcaaa

SEQ ID NO: 26754 - protein, 107 aa, Artificial Sequence
  Description of Artificial Sequence: Synthetic polypeptide
DIQMTQSPSSLSASVGDRVTITCRTSQGIGNYLAWFQQKPGKAPKSLLYKASSLQSGVPSKFSGSGSGTDFTLTISSLQPEDFATYYCQQYITYPLTFGGGTKVEIK

SEQ ID NO: 26755 - DNA, 336 bp, Artificial Sequence
  Description of Artificial Sequence: Synthetic polynucleotide
gatattgtaatgacccagactccactctctctgtccgtcacccctggacagccggcctccatctcctgcaagtctagtcagagcctcctccatagtgatggaaggacctatttgtattggtacctgcagaggccaggccagcctccacagctcctgatctgtgaggtttccaaccggttcgctggagtgacagataggttcagtggcagcgggtcagggacagatttcacactgaaaatcagccgggtggaggctggggatgttggggtttattactgcatgcaaagtatacagcttccctggacgttcggccaagggaccaaggtggaaatcaaa

SEQ ID NO: 26756 - protein, 112 aa, Artificial Sequence
  Description of Artificial Sequence: Synthetic polypeptide
DIVMTQTPLSLSVTPGQPASISCKSSQSLLHSDGRTYLYWYLQRPGQPPQLLICEVSNRFAGVTDRFSGSGSGTDFTLKISRVEAGDVGVYYCMQSIQLPWTFGQGTKVEIK

SEQ ID NO: 26757 - DNA, 321 bp, Artificial Sequence
  Description of Artificial Sequence: Synthetic polynucleotide
gacatccagatgacccagtctccatcctcactgtctgcatctgtgggagacagagtcaccatcacttgtcgggcgagtcagggcattggcaagtatttagcctggtttcagcagaaaccagggaaagcccctaagtcactgatctatgctgcatccagtttgcaaagtggggtcccatcaaagttcagcggcagtgggtctgggacagatttcactctcaccatcagcagcctgcagcctgacgattttgcaacttattactgccaacgatatgatacttacccattcactttcggccctgggaccaaagtggatttcaaa

SEQ ID NO: 26758 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYAASSLQSGVPSKFSGSGSGTDFTLTISSLQPDDFATYYCQRYDTYPFTFGPGTKVDFK

SEQ ID NO: 26759 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcaactatttaaattggtatcagcagacaccaggaaaagcccctaagctcctgatctatgctgaatccagtttacaaagtggggtcccatcaaggttcagtggcagtggatctgggacagatttcactctcaccatcagcagtctgcaacctgaagattttgcaacttactcctgtcaacagagttacagttcccctccgtggacgttcggccaagggaccaaggtggaaatcaaa

SEQ ID NO: 26760 - protein, 108 aa, Artificial Sequence
  Description of Artificial Sequence: Synthetic polypeptide
DIQMTQSPSSLSASVGDRVTITCRASQSISNYLNWYQQTPGKAPKLLIYAESSLQSGVPSRFSGSGSGTDFTLTISSLQPEDFATYSCQQSYSSPPWTFGQGTKVEIK

SEQ ID NO: 26761 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaagtatttagcctggtttcagcagaaaccagggaaagcccctaagtccctgatctatgctgcatccagtttgcaaagtggggtcccatcaaagttcagcggcagtggatatgggacagatttcactctcaccatcagcagcctgcagcctgaaaattttgcaacttattactgccaacagtatagtacttacccgctcactttcggcggagggaccaaggtggagatcaag

SEQ ID NO: 26762 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYAASSLQSGVPSKFSGSGYGTDFTLTISSLQPENFATYYCQQYSTYPLTFGGGTKVEIK

SEQ ID NO: 26763 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgtcagaagcgacttcttagcctggctccagcagaaacctggccaggctcccaggctcctcatctatggtgtatcccgcagggccactggcatcccagacaggttcagtggcagtgggtctgggacagacttcactctcaccatcaacagactggagcctgaagattttgcagtgtattactgtcagcagtatggtaactcaccgtggacgttcggccaagggaccaaggtggaaatcaaa

SEQ ID NO: 26764 - protein, 108 aa, Artificial Sequence
  Description of Artificial Sequence: Synthetic polypeptide
EIVLTQSPGTLSLSPGERATLSCRASQSVRSDFLAWLQQKPGQAPRLLIYGVSRRATGIPDRFSGSGSGTDFTLTINRLEPEDFAVYYCQQYGNSPWTFGQGTKVEIK

SEQ ID NO: 26765 - DNA, 324 bp, Artificial Sequence
  Description of Artificial Sequence: Synthetic polynucleotide
gaaattgtgttgacgcagtctccaggcaccctgtctttgtctccaggggaaagagccaccctctcttgtagggccagtcagagtgttagaagcaacttcttagcctggcaccagcagaaacctggccaggctcccaggctcttcatctatggtgcatcccgcagggccactggcatcccagacaggttcagtggcagtgggtctgggacagacttcactctcaccatcaacagactggagcctgaagattttgcagtgtattactgtcagcagtatggtaactcaccgtggacgttcggccaagggaccaaggtggaaatcaaa

SEQ ID NO: 26766 - protein, 108 aa, Artificial Sequence
  Description of Artificial Sequence: Synthetic polypeptide
EIVLTQSPGTLSLSPGERATLSCRASQSVRSNFLAWHQQKPGQAPRLFIYGASRRATGIPDRFSGSGSGTDFTLTINRLEPEDFAVYYCQQYGNSPWTFGQGTKVEIK

SEQ ID NO: 26767 - DNA, 324 bp, Artificial Sequence
  Description of Artificial Sequence: Synthetic polynucleotide
gaaattgtgttgacgcagtctccaggcaccctgtctttgtctccaggggacagagccaccctctcttgcagggccagtcagagtgttagaagcaacttcttagcctggcaccagcagaaacctggccaggctcccaggctcctcatctatggtgcatcccgcagggccactggcatcccagacaggttcagtggcagtgggtctgggacagacttcactctcaccatcaacagactggaacctgaagattttgcagtgtatttctgtcagcagtatggtaactcaccgtggacgttcggccaagggaccaaggtggaaatcaaa

SEQ ID NO: 26768 - protein, 108 aa, Artificial Sequence
  Description of Artificial Sequence: Synthetic polypeptide
EIVLTQSPGTLSLSPGDRATLSCRASQSVRSNFLAWHQQKPGQAPRLLIYGASRRATGIPDRFSGSGSGTDFTLTINRLEPEDFAVYFCQQYGNSPWTFGQGTKVEIK

SEQ ID NO: 26769 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattaacaactggttagcctggtatcagcagaaaccagggaaagcccctaagctcctgatctatggtgtttccagtttgcaaagtggggtcccatcaaggttcagcggcagtggatctgggacagatttcactctcaccatcagcagcctgcagcctgaagattttgcaacttactcttgtcaacaggctaacagtttcccgtggacgttcggccaagggaccaaggtggaaatcaga

SEQ ID NO: 26770 - protein, 107 aa, Artificial Sequence; identical to SEQ ID NO: 26652
  Description of Artificial Sequence: Synthetic polypeptide

SEQ ID NO: 26771 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattcgcagcagcttcttagcctggtatcagcagaaacctggccaggctcccaggctcctcatctatggtgcatccaacagggccactggcatcccagacaggttcagtggcagtgggtctgggacagacttcactctcaccatcagcagactggagcctgaagattttgcagtgtattactgtcagcagtatggtaactcaccgtgggcgttcggccaagggaccaaggtggaaatcaaa

SEQ ID NO: 26772 - protein, 108 aa, Artificial Sequence
  Description of Artificial Sequence: Synthetic polypeptide
EIVLTQSPGTLSLSPGERATLSCRASQSIRSSFLAWYQQKPGQAPRLLIYGASNRATGIPDRFSGSGSGTDFTLTISRLEPEDFAVYYCQQYGNSPWAFGQGTKVEIK

SEQ ID NO: 26773 - DNA, 324 bp, Artificial Sequence
  Description of Artificial Sequence: Synthetic polynucleotide
gaaattgtgttgacgcagtctccaggcaccctgtctttgtctccaggggaaagcgccaccctctcctgcagggccggtcaaagtattagaaccgacttcttagtctggtaccagcagcaacctggccaggctcccaggctcctcatctatggtgcatccagcagggccactggcttcccagagaggttcagtggcagtgggtctgggacagacttcactctcaccatcaacagactggagcctgaagattttgcagtgtattactgtcagcagtatggaagctcaccgtggacgttcggccaagggaccaaggtggaaatcaat

SEQ ID NO: 26774 - protein, 108 aa, Artificial Sequence
  Description of Artificial Sequence: Synthetic polypeptide
EIVLTQSPGTLSLSPGESATLSCRAGQSIRTDFLVWYQQQPGQAPRLLIYGASSRATGFPERFSGSGSGTDFTLTINRLEPEDFAVYYCQQYGSSPWTFGQGTKVEIN

SEQ ID NO: 26775 - DNA, 321 bp, Artificial Sequence
  Description of Artificial Sequence: Synthetic polynucleotide
gacatccagatgacccagtctccatcctccctgtctgcatctgttggagacagagtcaccatcacttgccggccgagtcagggcattagcatttatttagcctggtatcagcagaaaccagggaatgttcctaagctcctgatctatgctgcatccactttacaatcaggggtcccatctcggttcagtggcagtggatctgggacagatttcactctcaccatcagcagcctgcagcctgaagatgttgcaacttattactgtcaaaagtataacagtgccccattcactttcggccctgggaccaaagtggatatcaaa

SEQ ID NO: 26776 - protein, 107 aa, Artificial Sequence
  Description of Artificial Sequence: Synthetic polypeptide
DIQMTQSPSSLSASVGDRVTITCRPSQGISIYLAWYQQKPGNVPKLLIYAASTLQSGVPSRFSGSGSGTDFTLTISSLQPEDVATYYCQKYNSAPFTFGPGTKVDIK

SEQ ID NO: 26777 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaattataactacttgacttggtaccagcagaaaccaggacagcctcctaagctgctcatttactgggcatctacccgaaaatccggggtccctgaccgattcagtggcagcgggtctgggacagatttcactctcaccatcagcagcctgcaggctgacgatgtggcagtttattactgtcagcaatattatattactccgtggacgttcggccaagggaccaaggtggacatcaaa

SEQ ID NO: 26778 - protein, 113 aa, Artificial Sequence
  Description of Artificial Sequence: Synthetic polypeptide
DIVMTQSPDSLAVSLGERATINCKSSQSVLYSSNNYNYLTWYQQKPGQPPKLLIYWASTRKSGVPDRFSGSGSGTDFTLTISSLQADDVAVYYCQQYYITPWTFGQGTKVDIK

SEQ ID NO: 26779 - DNA, 321 bp, Artificial Sequence
  Description of Artificial Sequence: Synthetic polynucleotide
gacatccagatgacccagtctccatcctccctgtttgcatctgtaggagacagagtcatcatctcttgccgggcaagtcagggcattagaaatgatttagggtggtatcagcagtatccagggaaagcccctaagcgcgtgatttatgctgcatccagtttgcaaagtggggtcccatcaaggttcagcggcagtggatttgggacagaattcactatcacaatcagcagcgtgcagcctgaagattttgaaacttattactgtctacagcataatgatttcccgttcactttcggcggagggaccaaggtggagatcaaa

SEQ ID NO: 26780 - protein, 107 aa, Artificial Sequence
  Description of Artificial Sequence: Synthetic polypeptide
DIQMTQSPSSLFASVGDRVIISCRASQGIRNDLGWYQQYPGKAPKRVIYAASSLQSGVPSRFSGSGFGTEFTITISSVQPEDFETYYCLQHNDFPFTFGGGTKVEIK

SEQ ID NO: 26781 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtcgtttaccattcactttcggccctgggaccaaagtggatatcaaa

SEQ ID NO: 26782 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAATYYCHQSSRLPFTFGPGTKVDIK

SEQ ID NO: 26783 - DNA, 324 bp, Artificial Sequence
  Description of Artificial Sequence: Synthetic polynucleotide
gaaattgtgttggcgcagtctccaggcaccctgtctttgtctccaggggaaagagccaccctctcctgcagggccagtcagagtgttaggagcggttacttagcctggtaccagcagaaacctggccaggctcccaggctcctcatctatggtgcatccagcagggccactggcatcccagacaggttcggtggcagtgggtctgggacagacttcactctcaccatcagcagactggagcctgaagattttgcagtgtattactgtcagcagtatgagagttcaccgtggacgttcggccaagggaccaaggtggaaatcaaa

SEQ ID NO: 26784 - protein, 108 aa, Artificial Sequence
  Description of Artificial Sequence: Synthetic polypeptide
EIVLAQSPGTLSLSPGERATLSCRASQSVRSGYLAWYQQKPGQAPRLLIYGASSRATGIPDRFGGSGSGTDFTLTISRLEPEDFAVYYCQQYESSPWTFGQGTKVEIK

SEQ ID NO: 26785 - DNA, 324 bp, Artificial Sequence
  Description of Artificial Sequence: Synthetic polynucleotide
gaaattgtgttgacgcagtctccaggcaccctgtctttgtctccaggggaaagcgccaccctctcctgcagggccggtcaaagtattagaaccaacttcttagcctggtaccagcagcaacctggccaggctcccaggctcctcatctatggtgcatccagcagggccactggcatcccagacaggttcagtggcagtgggtctgggacagacttcactctcaccatcaacagactggagcctgaagattttgcagtgtatttctgtcagcagtatggtagctcaccgtggacgttcggccaagggaccaaggtggaaatcaat

SEQ ID NO: 26786 - protein, 108 aa, Artificial Sequence
  Description of Artificial Sequence: Synthetic polypeptide
EIVLTQSPGTLSLSPGESATLSCRAGQSIRTNFLAWYQQQPGQAPRLLIYGASSRATGIPDRFSGSGSGTDFTLTINRLEPEDFAVYFCQQYGSSPWTFGQGTKVEIN

SEQ ID NO: 26787 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaagtatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtatagtacttacccgctcactttcggcggagggaccaaggtggagatcaaa

SEQ ID NO: 26788 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYAASSLQSGVPSKFSGSGSGTDFTLTISSLQPEDFATYYCQQYSTYPLTFGGGTKVEIK

SEQ ID NO: 26789 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctaatctattctgcatccagtttgcaaaggggggtcccatcaagattcagcggcagtggatctgggacagaattcactctcacaatcagcagcctgcagcctgaagattttgcaacttattactgtctacagcataaaaggtacccgctcactttcggcggagggaccaaggtggagatcaaa

SEQ ID NO: 26790 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYSASSLQRGVPSRFSGSGSGTEFTLTISSLQPEDFATYYCLQHKRYPLTFGGGTKVEIK

SEQ ID NO: 26791 - DNA, 324 bp, Artificial Sequence
  Description of Artificial Sequence: Synthetic polynucleotide
gaaattgtgttgacgcagtctccaggcaccctgtttttgtctccaggggaaagagccaccctctcctgcagggccagtcagagtattcgcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtaactcaccgtgggcgttcggccaagggatcaaggtggaagtcaaa

SEQ ID NO: 26792 - protein, 108 aa, Artificial Sequence
  Description of Artificial Sequence: Synthetic polypeptide
EIVLTQSPGTLFLSPGERATLSCRASQSIRSSFLAWYQQKPGQAPRLLIYGASSRATGIPDRFSGSGSGTDFTLTISRLEPEDFAVYYCQQYGNSPWAFGQGIKVEVK

SEQ ID NO: 26793 - DNA, 324 bp, Artificial Sequence
  Description of Artificial Sequence: Synthetic polynucleotide
gaaattgtgttgaagcagtctccaggcaccctgtttttgtctccaggggagagagccaccctctcctgcagggccagtcagagtataaggaccaacttcttagcctggtaccagcagaaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtaactcaccgtggacgttcggccaagggaccaaggtggaaatcaaa

SEQ ID NO: 26794 - protein, 108 aa, Artificial Sequence
  Description of Artificial Sequence: Synthetic polypeptide
EIVLKQSPGTLFLSPGERATLSCRASQSIRTNFLAWYQQKPGQAPRLLIYGASSRATGIPDRFSGSGSGTDFTLTINRLEPEDFAVYYCQQYGNSPWTFGQGTKVEIK

SEQ ID NO: 26795 - DNA, 321 bp, Artificial Sequence
  Description of Artificial Sequence: Synthetic polynucleotide
gacatccagatgatccagtctccatcctcactgtctgcatctgtaggagacagagtcaccatcacttgtcgggcgagtcagggcgttagcaatcatttagcctggtttcagcagaaaccagggagagcccctaagtccctgatctatgctgcatccagtttgcaaagtggggtcccatcaaagttcagcggcagtggatctggggcagatttcactctcaccatcagcagcctgcagcctgaagattttgcaacttattactgccaacagtataatagttacccattcactttcggccctgggaccaaagtggatatcaaa

SEQ ID NO: 26796 - protein, 107 aa, Artificial Sequence
  Description of Artificial Sequence: Synthetic polypeptide
DIQMIQSPSSLSASVGDRVTITCRASQGVSNHLAWFQQKPGRAPKSLIYAASSLQSGVPSKFSGSGSGADFTLTISSLQPEDFATYYCQQYNSYPFTFGPGTKVDIK

SEQ ID NO: 26797 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagaaccaacttcttagcctggcaccagcagaaacctggccaggctcccaggctcctcatctatggtgcatcccgcagggccactggcatcccagacaggttcagtggcagtgggtctgggacagacttcactctcaccatcaacagactggagcctgaagattttgcactgtattactgtcagcagtatggtaactcaccgtggacgttcggccaagggaccaaggtggaaatcaaa

SEQ ID NO: 26798 - protein, 108 aa, Artificial Sequence
  Description of Artificial Sequence: Synthetic polypeptide
EIVLTQSPGTLSLSPGERATLSCRASQSVRTNFLAWHQQKPGQAPRLLIYGASRRATGIPDRFSGSGSGTDFTLTINRLEPEDFALYYCQQYGNSPWTFGQGTKVEIK

SEQ ID NO: 26799 - DNA, 321 bp, Artificial Sequence
  Description of Artificial Sequence: Synthetic polynucleotide
gaaattgtactgactcagtctccagattttcagtctgtgactccaaaggagaaagtcaccatcacctgccgggccagtcagagcattggtaggagtttacactggtaccagcagagaccagatcagtctctaaagctcctcatcaagtatgcttcccagtcattctcaggggtcccctcgaggttcagtggcagtggatctgggacagatttcaccctcaccatcaatagcctggaggctgaagatgctgcaacgtatttctgtcatcagagtagtcgtttaccgctcactttcggcggcgggaccaaggtggagatcaaa

SEQ ID NO: 26800 - protein, 107 aa, Artificial Sequence
  Description of Artificial Sequence: Synthetic polypeptide
EIVLTQSPDFQSVTPKEKVTITCRASQSIGRSLHWYQQRPDQSLKLLIKYASQSFSGVPSRFSGSGSGTDFTLTINSLEAEDAATYFCHQSSRLPLTFGGGTKVEIK

SEQ ID NO: 26801 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctggaacagatttcactctcaccatcagcagcctgcagcctgaagattttgcaacttatttctgccaacattatcttacttaccctctcactttcggcggagggaccaaggtggagatcaaa

SEQ ID NO: 26802 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYFCQHYLTYPLTFGGGTKVEIK

SEQ ID NO: 26803 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtccgagtgttagcagcagctacttagcctggtaccagcaaaaacctggccaggctcccaggctcgtcatctatggtgcatccaggagggccactggcatcccagacaggttcagaggcagtgggtctgggacagacttcactctcaccatcagtagactggagcctgaggattttgcagtgtattactgtcagcagtatggtagctcacctccgtggacgttcggccaagggaccaaggtggaaatcaaa

SEQ ID NO: 26804 - protein, 109 aa, Artificial Sequence
  Description of Artificial Sequence: Synthetic polypeptide
EIVLTQSPGTLSLSPGERATLSCRASPSVSSSYLAWYQQKPGQAPRLVIYGASRRATGIPDRFRGSGSGTDFTLTISRLEPEDFAVYYCQQYGSSPPWTFGQGTKVEIK

SEQ ID NO: 26805 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattcgcagcagcttcttagcctggtatcagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtaactcaccgtgggcgttcggccaagggaccaaggtggaaatcaaa

SEQ ID NO: 26806 - protein, 108 aa, Artificial Sequence
  Description of Artificial Sequence: Synthetic polypeptide
EIVLTQSPGTLSLSPGERATLSCRASQSIRSSFLAWYQQKPGQAPRLLIYDASSRATGIPDRFSGSGSGTDFTLTISRLEPEDFAVYYCQQYGNSPWAFGQGTKVEIK

SEQ ID NO: 26807 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcagcagcttagcctggtatcagcagaaacctggccaggctcccaggatcctcatctctggtgcatccaccagggccactggtatcccagccaggttcagtggcagtgggtctgggacagagttcactctcaccatcagcagcctgcagtctgcagattttgcagtttattactgccagcagtataataactggccgtgcagttttggccaggggaccaagctggagatcaaa

SEQ ID NO: 26808 - protein, 107 aa, Artificial Sequence
  Description of Artificial Sequence: Synthetic polypeptide
EIVMTQSPATLSVSPGERATLSCRASQSVSSSLAWYQQKPGQAPRILISGASTRATGIPARFSGSGSGTEFTLTISSLQSADFAVYYCQQYNNWPCSFGQGTKLEIK

SEQ ID NO: 26809 - DNA, 321 bp, Artificial Sequence; identical to SEQ ID NO: 26733
  Description of Artificial Sequence: Synthetic polynucleotide

SEQ ID NO: 26810 - protein, 107 aa, Artificial Sequence; identical to SEQ ID NO: 26734
  Description of Artificial Sequence: Synthetic polypeptide

SEQ ID NO: 26811 - DNA, 321 bp, Artificial Sequence; identical to SEQ ID NO: 26691
  Description of Artificial Sequence: Synthetic polynucleotide

SEQ ID NO: 26812 - protein, 107 aa, Artificial Sequence; identical to SEQ ID NO: 26594
  Description of Artificial Sequence: Synthetic polypeptide

SEQ ID NO: 26813 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcggggtgttagcaacatctacttagcctggtaccaacagaaacctggccaggctcccaggctcctcatctatggtgcttccaacagggccactggcatcccagacaggttcagtggcagtgggtctgggacagacttcactctcaccatcagcagactggagcctgaagattttgcagtgtattactgtcagcacaatgattactcaatgttcactttcggccctgggaccaaagtggatatcaaa

SEQ ID NO: 26814 - protein, 108 aa, Artificial Sequence
  Description of Artificial Sequence: Synthetic polypeptide
EIVLTQSPGTLSLSPGERATLSCRASRGVSNIYLAWYQQKPGQAPRLLIYGASNRATGIPDRFSGSGSGTDFTLTISRLEPEDFAVYYCQHNDYSMFTFGPGTKVDIK

SEQ ID NO: 26815 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctccatagtgatggaaggacctatttgtattggtacctgcagaagccaggccagcctccacagctcctgatctgtgaggtttccaaccggttctctggagtgccagataggttcagtggcagcgggtcagggacagatttcacactgaaaatcagccgggtggaggctggggatgttggggtttattactgcatgcaaagtatacagcttccctggacgttcggccaagggaccaaggtggaaatcaaa

SEQ ID NO: 26816 - protein, 112 aa, Artificial Sequence
  Description of Artificial Sequence: Synthetic polypeptide
DIVMTQTPLSLSVTPGQPASISCKSSQSLLHSDGRTYLYWYLQKPGQPPQLLICEVSNRFSGVPDRFSGSGSGTDFTLKISRVEAGDVGVYYCMQSIQLPWTFGQGTKVEIK

SEQ ID NO: 26817 - DNA, 324 bp, Artificial Sequence
  Description of Artificial Sequence: Synthetic polynucleotide
gaaattgtgttgacgcagtctccaggcaccctgtctttgtctccaggggaaagcgccaccctctcctgcagggccggtcaaagtattagaaccaacttcttagcctggtaccagcagaaacctggccaggctcccaggctcctcatctatggtgcatccagcagggccactggcatcccagacaggttcagtggcagtgggtctgggacagacttcactctcaccatcaacagactggagcctaaagattttgcagtgtattactgtcagcagtatggtagttcaccgtggacgttcggccaagggaccaaggtggaaatcaaa

SEQ ID NO: 26818 - protein, 108 aa, Artificial Sequence
  Description of Artificial Sequence: Synthetic polypeptide
EIVLTQSPGTLSLSPGESATLSCRAGQSIRTNFLAWYQQKPGQAPRLLIYGASSRATGIPDRFSGSGSGTDFTLTINRLEPKDFAVYYCQQYGSSPWTFGQGTKVEIK

SEQ ID NO: 26819 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagaagcaacttcttagcctggtatcagcagaaacctggccaggctcccaggctcctcatctatggtgcatccagcagggccactggcatcccagacaggttcagtggcagtgtgtctgggacagacttcactctcaccatcaacagactggagcctgaagattttgcagtgtattactgtcagcagtatggtagctcaccgtggacgttcggccaagggaccaaggtggaaatcaaa

SEQ ID NO: 26820 - protein, 108 aa, Artificial Sequence
  Description of Artificial Sequence: Synthetic polypeptide
EIVLTQSPGTLSLSPGERATLSCRASQSIRSNFLAWYQQKPGQAPRLLIYGASSRATGIPDRFSGSVSGTDFTLTINRLEPEDFAVYYCQQYGSSPWTFGQGTKVEIK

SEQ ID NO: 26821 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaaatatttagcctggtttcagcagaaaccagggaaagcccctaagtccctgatctatggtgcatccaggttgcaaagtggggtcccatcaaagttcagcggcagtggatctgggacagatttcactctcaccatcagcagcctgcagcctgaagattttgcaacttattactgccaacattatcttaattaccctctcaccttcggccaagggacacgactggagattaaa

SEQ ID NO: 26822 - protein, 107 aa, Artificial Sequence
  Description of Artificial Sequence: Synthetic polypeptide
DIQMTQSPSSLSASVGDRVTITCRASQGISKYLAWFQQKPGKAPKSLIYGASRLQSGVPSKFSGSGSGTDFTLTISSLQPEDFATYYCQHYLNYPLTFGQGTRLEIK

SEQ ID NO: 26823 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtttcagcagaaaccagggaaagcccctaagatcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccgtggacgttcggccaagggaccaaggtggaaatcaaa

SEQ ID NO: 26824 - protein, 107 aa, Artificial Sequence
  Description of Artificial Sequence: Synthetic polypeptide
DIQMTQSPSSVSASVGDRVTITCRASQGISRWLAWFQQKPGKAPKILIYAASSLQSGVPSRFSGSGSGTDFTLTISSLQPEDFATYYCQQANSFPWTFGQGTKVEIK

SEQ ID NO: 26825 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtccgagtgttaacagcggctacttagcctggtaccagcagaagcctggccagactcccaggctcctcatctttggtgcatccagcagggccactggcatccccgacaggttcagtgccagtgggtctggggcagacttcactctcaccatcagtagactggagcctgaagattttgcagtgtatttctgtcagcagtatgaaagctcaccgtggacgttcggccaagggaccaaggtggaaatcaaa

SEQ ID NO: 26826 - protein, 108 aa, Artificial Sequence
  Description of Artificial Sequence: Synthetic polypeptide
EIVLTQSPGTLSLSPGERATLSCRASPSVNSGYLAWYQQKPGQTPRLLIFGASSRATGIPDRFSASGSGADFTLTISRLEPEDFAVYFCQQYESSPWTFGQGTKVEIK

SEQ ID NO: 26827 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagctgaaaccagggaaagcccctaagcgcctgatctatgctgcatccagtttacaaagtggggtcccatcaaggttcagcggcagtggatctgggccagaattcactctcacaatcagcagcctgcagcctgaagattttgcaacttattactgtctacagcattatagtttcccattcactttcggccctgggaccaaagtggatatcaaa

SEQ ID NO: 26828 - protein, 107 aa, Artificial Sequence; identical to SEQ ID NO: 26696
  Description of Artificial Sequence: Synthetic polypeptide

SEQ ID NO: 26829 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttacaaagtggggtcccatcaaagttcagcggcagtggatctggaacagatttcactctcaccatcagcagcctgcagcctgaagattttgcaacttattactgccaacattatcttacttaccctctcactttcggcggagggaccaaggtggagatcaaa

SEQ ID NO: 26830 - protein, 107 aa, Artificial Sequence; identical to SEQ ID NO: 26622
  Description of Artificial Sequence: Synthetic polypeptide

SEQ ID NO: 26831 - DNA, 321 bp, Artificial Sequence
  Description of Artificial Sequence: Synthetic polynucleotide
gacatccagatgacccagtctccatcctcactgtctgcatctgtgggagacagagtcaccatcactcgtcgggcgagtcagggcattggcaagtatttagcatggtttcagcagaaaccagggaaagcccttaagtcactgatatatgctgcatccagtttgcaaagtggggtcccatcaaaattcagcggcagtggatctgggacagatttcactctcaccatcagcagcctgcagcctgacgattttgcaacttattactgccaacgatatgatacttacccattcactttcggccctgggaccaaagtggatatcaaa

SEQ ID NO: 26832 - protein, 107 aa, Artificial Sequence
  Description of Artificial Sequence: Synthetic polypeptide
DIQMTQSPSSLSASVGDRVTITRRASQGIGKYLAWFQQKPGKALKSLIYAASSLQSGVPSKFSGSGSGTDFTLTISSLQPDDFATYYCQRYDTYPFTFGPGTKVDIK

SEQ ID NO: 26833 - DNA, 324 bp, Artificial Sequence
  Description of Artificial Sequence: Synthetic polynucleotide
gaaattgtgttgacgcagtctccaggcaccctgtctttgtcttcaggggaaagagccaccctctcctgcagggccagtccgagtgttaacagtaactacttagcctggtatcagcagaaacctggccagactcccaggctcctcatctatggtgcatccaacagggccactggcgtcccagacaggttcagtgccagtgggtctgggacagacttcactctcaccatcagaagactggagcctgaagattttgcagtgtatttctgtcagcagtatgaaagctcaccgtggacgttcggccaagggaccaaggtggaaatcaaa

SEQ ID NO: 26834 - protein, 108 aa, Artificial Sequence
  Description of Artificial Sequence: Synthetic polypeptide
EIVLTQSPGTLSLSSGERATLSCRASPSVNSNYLAWYQQKPGQTPRLLIYGASNRATGVPDRFSASGSGTDFTLTIRRLEPEDFAVYFCQQYESSPWTFGQGTKVEIK

SEQ ID NO: 26835 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctatgctgcatccagtttgctaggtggggtcccatcaaggttcagcggcagtggatctgggacagatttcactctcaccatcagcagcctgcagcctgaagattttgcaacttactattgtcaacgggctaacagtttcccgtgcagttttggccaggggaccaagctggagatcaaa

SEQ ID NO: 26836 - protein, 107 aa, Artificial Sequence
  Description of Artificial Sequence: Synthetic polypeptide
DIQMTQSPSSVSASVGDRVTITCRASQGISRWLAWYQQKPGKAPKLLIYAASSLLGGVPSRFSGSGSGTDFTLTISSLQPEDFATYYCQRANSFPCSFGQGTKLEIK

SEQ ID NO: 26837 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcgccctcaccatcagtagcctggaagctgaagatgctgcaacgtattactgtcatcagagtagaactttaccgctcactttcggcggagggaccaaggtggagatcaaa

SEQ ID NO: 26838 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFALTISSLEAEDAATYYCHQSRTLPLTFGGGTKVEIK

SEQ ID NO: 26839 - DNA, 321 bp, Artificial Sequence
  Description of Artificial Sequence: Synthetic polynucleotide
gacatccagatgacccagtctccttcctcactgtctgcatctgtaggagacagagtcaccatcacttgtcggacgagtcagggcattggcaagtatttagcctggtttcagcagaaaccagggaaagcccctaagtccctgctctataaagtatccagtttgcaaagtggggtcccatcaaagttcagcggcagtggatctgggacagatttcactctcaccatcagcagcctgcagcctgaagattttgcaacttattactgccaacagtatatgacttacccgctcactttcggcggagggaccaaggtggagatcaaa

SEQ ID NO: 26840 - protein, 107 aa, Artificial Sequence
  Description of Artificial Sequence: Synthetic polypeptide
DIQMTQSPSSLSASVGDRVTITCRTSQGIGKYLAWFQQKPGKAPKSLLYKVSSLQSGVPSKFSGSGSGTDFTLTISSLQPEDFATYYCQQYMTYPLTFGGGTKVEIK

SEQ ID NO: 26841 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattcgcagcagcttcttagcctggtaccaacagaaacctggccaggctcccaggctcctcatctatggtgcatttagtagggccactggcatcccagacaggttcagtggcagtgggtctgggacagacttcactctcaccatcagcagactggagcctgaagattttgcagtgtattactgtcagcagtatggtaactcaccgtgggcgttcggccaagggaccaaggtggaaatcaaa

SEQ ID NO: 26842 - protein, 108 aa, Artificial Sequence
  Description of Artificial Sequence: Synthetic polypeptide
EIVLTQSPGTLSLSPGERATLSCRASQSIRSSFLAWYQQKPGQAPRLLIYGAFSRATGIPDRFSGSGSGTDFTLTISRLEPEDFAVYYCQQYGNSPWAFGQGTKVEIK

SEQ ID NO: 26843 - DNA, 321 bp, Artificial Sequence; identical to SEQ ID NO: 26621
  Description of Artificial Sequence: Synthetic polynucleotide

SEQ ID NO: 26844 - protein, 107 aa, Artificial Sequence; identical to SEQ ID NO: 26622
  Description of Artificial Sequence: Synthetic polypeptide

SEQ ID NO: 26845 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcataagaaaagatttaggctggtatcagcagaaaccagggaaagcccctaagcgcctgatctatgctgcatccgatttgcaaagtggggtcccatcaaggttcagcggcagtggatctgggacagaattcactctcacaatcagcagcctgcagcctgaagattttgcaacttattgctgtctacagcattatcgttacccattcactttcggccctgggaccaaagtggatttcaaa

SEQ ID NO: 26846 - protein, 107 aa, Artificial Sequence
  Description of Artificial Sequence: Synthetic polypeptide
DIQMTQSPSSLSASVGDRVTITCRASQGIRKDLGWYQQKPGKAPKRLIYAASDLQSGVPSRFSGSGSGTEFTLTISSLQPEDFATYCCLQHYRYPFTFGPGTKVDFK

SEQ ID NO: 26847 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtggtcgtttaccgctcactttcggcggagggaccaaggtggagatcaaa

SEQ ID NO: 26848 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAATYYCHQSGRLPLTFGGGTKVEIK

SEQ ID NO: 26849 - DNA, 321 bp, Artificial Sequence; identical to SEQ ID NO: 26781
  Description of Artificial Sequence: Synthetic polynucleotide

SEQ ID NO: 26850 - protein, 107 aa, Artificial Sequence; identical to SEQ ID NO: 26782
  Description of Artificial Sequence: Synthetic polypeptide

SEQ ID NO: 26851 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcaactccaacaataagaactacttagcttggtaccagcagaaacccggtcagcctcctaacctgctcatttactgggcatctaccctggaatctggggtccctgaccgattcagtggcagcgggtgtgggacagatttcactctcaccatcagcagcatgcaggctgaagatgtggcagtttattactgtcagcaatattgtagttttccattcactttcggccctgggaccaaagtggatatcaga

SEQ ID NO: 26852 - protein, 113 aa, Artificial Sequence
  Description of Artificial Sequence: Synthetic polypeptide
DIVMTQSPDSLAVSLGERATINCKSSQSVLFNSNNKNYLAWYQQKPGQPPNLLIYWASTLESGVPDRFSGSGCGTDFTLTISSMQAEDVAVYYCQQYCSFPFTFGPGTKVDIR

SEQ ID NO: 26853 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattaacaactggttagcctggtatcagcagaaaccagggaaagcccctaagctcctgatctatggtgtttccagtttgcagagtggggtcccatcaaggttcagcggcagtggatctgggacagatttcactctcaccatcagcagcctgcagcctgaagattttgcaacttactcttgtcaacaggctaacagtttcccgtggacgttcggccgagggaccaaggtggaaaatcag

SEQ ID NO: 26854 - protein, 107 aa, Artificial Sequence
  Description of Artificial Sequence: Synthetic polypeptide
DIQMTQSPSSVSASVGDRVTITCRASQGINNWLAWYQQKPGKAPKLLIYGVSSLQSGVPSRFSGSGSGTDFTLTISSLQPEDFATYSCQQANSFPWTFGRGTKVENQ

SEQ ID NO: 26855 - DNA, 339 bp, Artificial Sequence
  Description of Artificial Sequence: Synthetic polynucleotide
gacatcgtgatgacccagtctccagactccctggctgtgtttctgggcgagagggccaccatcaactgcaagtccagccagagtattttattcagctccaacaataagaggtacttagcttggtatcagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattctagtcttccattcactttcggccctgggaccaaagtggatatcaaa

SEQ ID NO: 26856 - protein, 113 aa, Artificial Sequence
  Description of Artificial Sequence: Synthetic polypeptide
DIVMTQSPDSLAVFLGERATINCKSSQSILFSSNNKRYLAWYQQKPGQPPKLLIYWASIRESGVPDRFSGSGSGTDFTLTISSLQAEDVAVYYCQQYSSLPFTFGPGTKVDIK

SEQ ID NO: 26857 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttattcaactccaacaataagaactacttagcttggtaccagcagaaacccggtcagcttcctaacctgctcatttactgggcatctaccctggaatctggggtccctgaccgattcagtggcagcggctgtgggacagatttcactctcaccatcagcagcatgcaggctgaagatgtggcagtttattactgtcagcaatattgtagttttccattcactttcggccctgggaccaaagtggatatcaga

SEQ ID NO: 26858 - protein, 113 aa, Artificial Sequence
  Description of Artificial Sequence: Synthetic polypeptide
DIVMTQSPDSLAVSLGERATINCKSSQSVLFNSNNKNYLAWYQQKPGQLPNLLIYWASTLESGVPDRFSGSGCGTDFTLTISSMQAEDVAVYYCQQYCSFPFTFGPGTKVDIR

SEQ ID NO: 26859 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaaactcctgatctatgctgcatccagtttgcaaagtggggtcccatcaaggttcagcggcagtggatctgggacagatttcactctcaccatcagcagcctgcagcctgaagattttgcaacttactattgtcaacagactaacagtgtcccattcactttcggccctgggaccaaagtagatatcaaa

SEQ ID NO: 26860 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQTNSVPFTFGPGTKVDIK

SEQ ID NO: 26861 - DNA, 321 bp, Artificial Sequence
  Description of Artificial Sequence: Synthetic polynucleotide
gactttcagatgatccagtctccatcctccctgtctgcatctgtaggcgacagagtcaccatcacttgccgggcaagtcagcgcattcacagctatttaaattggtatcagcagaaaccagggaaagctcctaagctcctgatctatactgcatccagtttgcaaggtggggtcccatcaaggttcagtggcagtggatctgggacagatttcactctcaccatcagcagtctgcagcctgaagattttgcaacttactactgtcaacagagctacggttcccctctcactttcggcggagggaccaaggtggagatcaaa

SEQ ID NO: 26862 - protein, 107 aa, Artificial Sequence
  Description of Artificial Sequence: Synthetic polypeptide
DFQMIQSPSSLSASVGDRVTITCRASQRIHSYLNWYQQKPGKAPKLLIYTASSLQGGVPSRFSGSGSGTDFTLTISSLQPEDFATYYCQQSYGSPLTFGGGTKVEIK

SEQ ID NO: 26863 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgaatcaggccattagcaattatttagcctggtttcagcagaaaccagggaaagcccctaagtccctgatctatgctgcatccagtttgcaaagtggggtcccatcaaagttcagcggcagtggatctggaacagatttcactctcaccatcagcagcctgcagcctgaagattttgcaacttattactgccaacattatctcacttaccctctcactttcggcggagggaccaaggtggagatcaaa

SEQ ID NO: 26864 - protein, 107 aa, Artificial Sequence
  Description of Artificial Sequence: Synthetic polypeptide
DIQMTQSPSSLSASVGDRVTITCRANQAISNYLAWFQQKPGKAPKSLIYAASSLQSGVPSKFSGSGSGTDFTLTISSLQPEDFATYYCQHYLTYPLTFGGGTKVEIK

SEQ ID NO: 26865 - DNA, 339 bp, Artificial Sequence
  Description of Artificial Sequence: Synthetic polynucleotide
gacatcgtgatgacccagtctccagactccctgactgtgtctctgggcgagagggccaccgtcaactgcaagtccagccagagtgttttacacagctccaacaataacaactacttagcttggtaccagcagaaaccaggacagcctcctaagctgctcatttactgggcatctacccgggaatccggagtccctgaccgattcagtggcagcgggtctgggacagatttcactctcgccatcagcagcctgcaggctgaagatgtggcggtttattactgtcagcaatattataatactcctccgacattcggccaagggaccaaggtggaaatcaaa

SEQ ID NO: 26866 - protein, 113 aa, Artificial Sequence
  Description of Artificial Sequence: Synthetic polypeptide
DIVMTQSPDSLTVSLGERATVNCKSSQSVLHSSNNNNYLAWYQQKPGQPPKLLIYWASTRESGVPDRFSGSGSGTDFTLAISSLQAEDVAVYYCQQYYNTPPTFGQGTKVEIK

SEQ ID NO: 26867 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactgcttagcctggtatcagcagaaaccagggaaagcccctaagttcctgatctgtgctgcatccagtttgcaaagtgcggtcccatcaaggttcagcggcagtggatctgggacagatttcactctcaccatcagcagcctgcagcctgaagattttgcatcttactattgtcaacagggtgacagtttccctccgacgttcggccaagggaccaaggtggaattcaga

SEQ ID NO: 26868 - protein, 107 aa, Artificial Sequence
  Description of Artificial Sequence: Synthetic polypeptide
DIQMTQSPSSVSASVGDRVTITCRASQGISNCLAWYQQKPGKAPKFLICAASSLQSAVPSRFSGSGSGTDFTLTISSLQPEDFASYYCQQGDSFPPTFGQGTKVEFR

SEQ ID NO: 26869 - DNA, 321 bp, Artificial Sequence
  Description of Artificial Sequence: Synthetic polynucleotide
gacatccagatgacccagtatccatcttacgtgtctgcatctgtaggagacagagtcagcatcacttgtcgggcgagtcagggtattagcaggtggttagcctggtatcagcagaagccagggaaagccgccaagttcctgatctatgctgcatccagtttgctaggtggggtctcatcaaggttcagcggcagtggatctgggacagatttcactctcaccatcagcagcctgcagcctgaagattttgcaatttactattgtcaacgggataacagtttaccgtgcagttttggccaggggaccaagctggagatcaaa

SEQ ID NO: 26870 - protein, 107 aa, Artificial Sequence
  Description of Artificial Sequence: Synthetic polypeptide
DIQMTQYPSYVSASVGDRVSITCRASQGISRWLAWYQQKPGKAAKFLIYAASSLLGGVSSRFSGSGSGTDFTLTISSLQPEDFAIYYCQRDNSLPCSFGQGTKLEIK

SEQ ID NO: 26871 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggttctgggacagaattcactctcacaatcagcagcctgcagcctgaagattttgcaacttattactgtctacaatataatagttaccctctcactttcggcggagggaccaaggtggagatcaaa

SEQ ID NO: 26872 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQYNSYPLTFGGGTKVEIK

SEQ ID NO: 26873 - DNA, 327 bp, Artificial Sequence
  Description of Artificial Sequence: Synthetic polynucleotide
gaaattgtgttgacgcagtctccaggcaccctgttattgtctcccggggaaagagccaccctctcctgcagggccagtccgagtgttagcaacagcttcttagcctggtaccagcagaaacctggccaggctcccaggctcctcatctatggtgcatccagcagggccactggcatcccagacaggttcagtggcagtgggtctgggacagacttcactctcaccaacagcagactggagcctgaagattttgcagtgtattactgtcagcagtatggtagctcacctccgtggacgttcggccaagggaccaaggtagaactcaaa

SEQ ID NO: 26874 - protein, 109 aa, Artificial Sequence
  Description of Artificial Sequence: Synthetic polypeptide
EIVLTQSPGTLLLSPGERATLSCRASPSVSNSFLAWYQQKPGQAPRLLIYGASSRATGIPDRFSGSGSGTDFTLTNSRLEPEDFAVYYCQQYGSSPPWTFGQGTKVELK

SEQ ID NO: 26875 - DNA, 321 bp, Artificial Sequence
  Description of Artificial Sequence: Synthetic polynucleotide
gacatccagatgaccctgtctccatcgtccctgtttgcatgtgtaggagacagagtcatcatcacttgccgggcaagtcagggcattagaaatgatctaggctggtctcagcagaatccagggaaagcccctaagcgcctgatctatgctgcatccagtttgcaaagtggggtcccatcaaggttcagcggcagtggatctgggacagaattcactatcacaatcagcagcctgcagcctgaagattttgaaacttattactgtctacagcataatgatttcccgttcactttcggccgagggaccaaggtggagatcaaa

SEQ ID NO: 26876 - protein, 107 aa, Artificial Sequence
  Description of Artificial Sequence: Synthetic polypeptide
DIQMTLSPSSLFACVGDRVIITCRASQGIRNDLGWSQQNPGKAPKRLIYAASSLQSGVPSRFSGSGSGTEFTITISSLQPEDFETYYCLQHNDFPFTFGRGTKVEIK

SEQ ID NO: 26877 - DNA, 324 bp, Artificial Sequence
  Description of Artificial Sequence: Synthetic polynucleotide
gaaattgtgttgacgcagtctccaggcaccctgtttttgtctccaggggaaagagccaccctctcctgcagggccagtcagagtgttagaagcaacttcttagcctggcaccagcagaaacctggccaggctcccaggctcctcatctatggtgcataccgcagggccactggcatcccagacaggttcagtggcagtgggtctgggacagacttcactctcaccatcaacagactggagcctgaagattttgcagtgtattactgtcagcagtatggtaactcaccgtggacgttcggccaagggaccaaggtggaaatcaaa

SEQ ID NO: 26878 - protein, 108 aa, Artificial Sequence
  Description of Artificial Sequence: Synthetic polypeptide
EIVLTQSPGTLFLSPGERATLSCRASQSVRSNFLAWHQQKPGQAPRLLIYGAYRRATGIPDRFSGSGSGTDFTLTINRLEPEDFAVYYCQQYGNSPWTFGQGTKVEIK

SEQ ID NO: 26879 - DNA, 321 bp, Artificial Sequence
  Description of Artificial Sequence: Synthetic polynucleotide
gacatccagatgatccagtctccttcctcactgtctgcatctgtaggagacagagtcaccatcacttgtcggacgagtcagggcattggcaattatttagcctggtttcagcagaaaccagggaaagcccctaagtccctgctctataaaacatccagtttgcaaagtggggtcccatcaaagttcagcggcagtggatctgggacagatttcactctcaccatcagcagcctgcagcctgaagattttgcaacttattacttccaacaatatatcacttacccgctcactttcggcggagggaccaaggtggagatcaaa

SEQ ID NO: 26880 - protein, 107 aa, Artificial Sequence
  Description of Artificial Sequence: Synthetic polypeptide
DIQMIQSPSSLSASVGDRVTITCRTSQGIGNYLAWFQQKPGKAPKSLLYKTSSLQSGVPSKFSGSGSGTDFTLTISSLQPEDFATYYFQQYITYPLTFGGGTKVEIK

SEQ ID NO: 26881 - DNA, 321 bp, Artificial Sequence
  Description of Artificial Sequence: Synthetic polynucleotide
gacatccagatgacccagtctccgtcctcactgtctgcatctgtaggagacagagtcaccatcacttgtcgggcgagtcagggcattggcaatcatttagcctggtttcagcagaaaccagggaaagcccctaagtccctgatctatgctgcatccagtttgcaaagtggggtcccatcaaagttcagcggcagtagatctgggacagatttctctctcaccatcagcagcctgcagcctgaagattttgcaacttattactgccaacagtatagtaattacccggtcactttcggccctgggaccaaagtggatatcaag

SEQ ID NO: 26882 - protein, 107 aa, Artificial Sequence
  Description of Artificial Sequence: Synthetic polypeptide
DIQMTQSPSSLSASVGDRVTITCRASQGIGNHLAWFQQKPGKAPKSLIYAASSLQSGVPSKFSGSRSGTDFSLTISSLQPEDFATYYCQQYSNYPVTFGPGTKVDIK

SEQ ID NO: 26883 - DNA, 324 bp, Artificial Sequence
  Description of Artificial Sequence: Synthetic polynucleotide
gaaattgtgttgacgcagtctccaggcaccctgtctttgtctccaggggaaggagccaccctctcctgcagggccagtcagagtattcgcagcagcttcttagcctggtacctgcagaagcctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggaaactcaccgtgggcgttcggccaagggaccaaggtggaaatcaaa

SEQ ID NO: 26884 - protein, 108 aa, Artificial Sequence
  Description of Artificial Sequence: Synthetic polypeptide
EIVLTQSPGTLSLSPGEGATLSCRASQSIRSSFLAWYLQKPGQAPRLLIYGASSRATGIPDRFSGSGSGTDFTLTISRLEPEDFAVYYCQQYGNSPWAFGQGTKVEIK

SEQ ID NO: 26885 - DNA, 339 bp, Artificial Sequence
  Description of Artificial Sequence: Synthetic polynucleotide
gacatcatgatgacccagtcttcagactccctgactgtgtctctgggcgagagggccatcatcagctgcaggtccagccagagtgttttacacagcttcaacaattacaactacttagcttggtaccagcagaaagcaggacatcctcctaacctgctcatttactgggcatctacccgggaatccggggtccctgaccgattcagtggcagcgggtctgggacagatttcactctccccatcagcagcctgcaggctgaagatgtggcagtttattactgtcaacaatattatagtactcctccgacgttcggcctagggaccaaggtggaaatcaaa

SEQ ID NO: 26886 - protein, 113 aa, Artificial Sequence
  Description of Artificial Sequence: Synthetic polypeptide
DIMMTQSSDSLTVSLGERAIISCRSSQSVLHSFNNYNYLAWYQQKAGHPPNLLIYWASTRESGVPDRFSGSGSGTDFTLPISSLQAEDVAVYYCQQYYSTPPTFGLGTKVEIK

SEQ ID NO: 26887 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaaatatttagcctggtttcagcagaaaccagggaaagcccctaagtccctgatctatggtgcatccagtttgcaaagtggggtcccatcaaagttcagcggcagtggatctgggacagatttcactctcaccatcagcagcctgcagcctgaaaattttgcaacttattactgccaacaatatagtacttacccgctcactttcggcggagggaccaaggtggagatcaaa

SEQ ID NO: 26888 - protein, 107 aa, Artificial Sequence
  Description of Artificial Sequence: Synthetic polypeptide
DIQMTQSPSSLSASVGDRVTITCRASQGIGKYLAWFQQKPGKAPKSLIYGASSLQSGVPSKFSGSGSGTDFTLTISSLQPENFATYYCQQYSTYPLTFGGGTKVEIK

SEQ ID NO: 26889 - DNA, 339 bp, Artificial Sequence
  Description of Artificial Sequence: Synthetic polynucleotide
gacatcatgatgacccagtctccagactccctggctgtgtctctgggcgagagggccatcatcagctgcaggtccagccagagtgttttacacagctccaacaattacaactacttagcttggtaccagcagaaaccaggacatcctcctaacctgctcatttactgggcatctacccgggaatccggggtccctgaccgattcagtggcagcgggtctgggacagatttcactctcaccatcagcagcctgcaggctgaagatgtggcagtttattactgtcaacaatattatagtactcctccgacgttcggcctagggaccaaggtggaaatcaaa

SEQ ID NO: 26890 - protein, 113 aa, Artificial Sequence
  Description of Artificial Sequence: Synthetic polypeptide
DIMMTQSPDSLAVSLGERAIISCRSSQSVLHSSNNYNYLAWYQQKPGHPPNLLIYWASTRESGVPDRFSGSGSGTDFTLTISSLQAEDVAVYYCQQYYSTPPTFGLGTKVEIK

SEQ ID NO: 26891 - DNA, 339 bp, Artificial Sequence
  Description of Artificial Sequence: Synthetic polynucleotide
gacatcgtgatgaccccgtctccagactccctggctgtgtctctgggcgagagggccaccatcaactgcaagtccagccagagtgttttacacagttccaacaataagaactacttagcttggtaccagcagaaaccaggacagcctcctaagctgctcatttactgggcatctacccgggaatccggggtccctgaccgattcagtggcagcgggtctgggacagatttcactctcagcatcagcagcctgcaggctgaagatgtggcagtttattactgtcagcagtcttatactattccattcactttcggccctgggaccaaagtggataacaaa

SEQ ID NO: 26892 - protein, 113 aa, Artificial Sequence
  Description of Artificial Sequence: Synthetic polypeptide
DIVMTPSPDSLAVSLGERATINCKSSQSVLHSSNNKNYLAWYQQKPGQPPKLLIYWASTRESGVPDRFSGSGSGTDFTLSISSLQAEDVAVYYCQQSYTIPFTFGPGTKVDNK

SEQ ID NO: 26893 - DNA, 336 bp, Artificial Sequence
  Description of Artificial Sequence: Synthetic polynucleotide
gagattgtgatgacccagactccactttctctgtccgtcatccctggacagccggcctccatctcctgcaagtctagtcagaacctcctgcatagtgatggaaagacctatttgtattggtacctgcagaagccaggccagcctccacaggtcctgatctatgaagtttccaaccggttctctggggtgccagataggttcagtggcagcgggtcagggacagatttcacactgaaaattagccgggtggaggctgaggatgttggggtttattcctgcatgcaaagtatacagcttccctggacgttcgcccaagggtccaaggtggaaatcaaa

SEQ ID NO: 26894 - protein, 112 aa, Artificial Sequence
  Description of Artificial Sequence: Synthetic polypeptide
EIVMTQTPLSLSVIPGQPASISCKSSQNLLHSDGKTYLYWYLQKPGQPPQVLIYEVSNRFSGVPDRFSGSGSGTDFTLKISRVEAEDVGVYSCMQSIQLPWTFAQGSKVEIK

SEQ ID NO: 26895 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaactggttagcctggtttcagcagaaaccagggaaagcccctcagctcctgatctatgctgcatccagtttgcaaagtggggtcccatcaaggttcagcggcagtggatctgggacagacttcagtctcaccatcagcagcctgcagcctgaagattttgcaacttactattgtcaacaggctaacagtttcccgtggacgttcgggcaagggaccaaggtggaaatcaaa

SEQ ID NO: 26896 - protein, 107 aa, Artificial Sequence
  Description of Artificial Sequence: Synthetic polypeptide
DIQMTQSPSSVSASVGDRVTITCRASQGISNWLAWFQQKPGKAPQLLIYAASSLQSGVPSRFSGSGSGTDFSLTISSLQPEDFATYYCQQANSFPWTFGQGTKVEIK

SEQ ID NO: 26897 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatggtgcatccagtttacaaagtggggtcccatcgaggttcagcggcagtggatctgggacagaattcactctcacaatcagcagcctgcagcctgaagattttgcaacttattactgtctacagcattataggtacccattcactttcggccctggaaccaaagtggatatcaaa

SEQ ID NO: 26898 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYGASSLQSGVPSRFSGSGSGTEFTLTISSLQPEDFATYYCLQHYRYPFTFGPGTKVDIK

SEQ ID NO: 26899 - DNA, 321 bp, Artificial Sequence
  Description of Artificial Sequence: Synthetic polynucleotide
gacatccagatgacccagtctccatcctcgctgtctgcatctgtgggagacagagtcaccatcacttgtcgggcgagtcagggcattaacaagtatttatcctggtttcagcagaaaccagggaaagcccctaagtcattgatctatgctgcatccagtgtgcaaagtggggtcccatcaaaattcagcggcagtggatctgggacagatttcactctcaccatcagccgcctgcagcctgacgattttgcaacttattacggccaacgatatgacacttacccattcactttcggccctgggaccaaagtggatatcaaa

SEQ ID NO: 26900 - protein, 107 aa, Artificial Sequence
  Description of Artificial Sequence: Synthetic polypeptide
DIQMTQSPSSLSASVGDRVTITCRASQGINKYLSWFQQKPGKAPKSLIYAASSVQSGVPSKFSGSGSGTDFTLTISRLQPDDFATYYGQRYDTYPFTFGPGTKVDIK

SEQ ID NO: 26901 - DNA, 321 bp, Artificial Sequence
  Description of Artificial Sequence: Synthetic polynucleotide
gacatccagatgatccagtctccttcctcactgtctgcatctgtaggagacagagtcaccatcacttgtcggacgagtcagggcattggcaattatttagcctggtttcagcagaaaccagggaaagcccctaagtccctgctctataaaacatccagtttgcaaagtgggttcccatcaaagttcagcggcagtggatctgggacagatttcactctcaccatcagcagcctgcagcctgaagattttgcaacttattacttccaacaatatatgacttacccgctcactttcggcggagggaccaaggtggagatcaaa

SEQ ID NO: 26902 - protein, 107 aa, Artificial Sequence
  Description of Artificial Sequence: Synthetic polypeptide
DIQMIQSPSSLSASVGDRVTITCRTSQGIGNYLAWFQQKPGKAPKSLLYKTSSLQSGFPSKFSGSGSGTDFTLTISSLQPEDFATYYFQQYMTYPLTFGGGTKVEIK

SEQ ID NO: 26903 - DNA, 324 bp, Artificial Sequence
  Description of Artificial Sequence: Synthetic polynucleotide
gaaattgtgttgacgcagtctccaggcaccctgtctttgtctccaggggaaagcgccaccctctcctgcagggccggtcaaagtattagaaccaacttcttagcctggtaccagcagcaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtagctcaccgtggacgttcggccaagggaccaaggtggaaatcaaa

SEQ ID NO: 26904 - protein, 108 aa, Artificial Sequence; identical to SEQ ID NO: 26628
  Description of Artificial Sequence: Synthetic polypeptide

SEQ ID NO: 26905 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtataaggagcaacttcttagcctggtaccagcagaaacctggccaggctcccaggctcctcatctatggtgcattcagtagggccactggcatcccagacaggttcagtggcagtgggtctgggacagacttcactctcaccatcaacagactggagcctgaagattttgcagtgtattactgtcagcagtatggtaattcaccgtggacgttcggccaagggaccaaggtggaaatcaaa

SEQ ID NO: 26906 - protein, 108 aa, Artificial Sequence
  Description of Artificial Sequence: Synthetic polypeptide
EIVLTQSPGTLSLSPGERATLSCRASQSIRSNFLAWYQQKPGQAPRLLIYGAFSRATGIPDRFSGSGSGTDFTLTINRLEPEDFAVYYCQQYGNSPWTFGQGTKVEIK

SEQ ID NO: 26907 - DNA, 324 bp, Artificial Sequence
  Description of Artificial Sequence: Synthetic polynucleotide
gaaattgtggtgacgcagtctccaggcaccctgttattgtattccgaggagagatccaccctctcctgcagggccagtcagagtgttagaagcagctacttagcctggtaccagcagaaacctggccaggctcccaggctcctcatctgtggtgcattcagcagggccagtggcatcccagacaggttcagtggcagtgggtctgggacagacttcactctcaccatcagcagactggagcctgaagatttcgcagtgtactactgtcagcagtatggtaactcaccgtggacgttgggccacgcgaccaaggtggaaatcaaa

SEQ ID NO: 26908 - protein, 108 aa, Artificial Sequence
  Description of Artificial Sequence: Synthetic polypeptide
EIVVTQSPGTLLLYSEERSTLSCRASQSVRSSYLAWYQQKPGQAPRLLICGAFSRASGIPDRFSGSGSGTDFTLTISRLEPEDFAVYYCQQYGNSPWTLGHATKVEIK

SEQ ID NO: 26909 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaattatttagcctggtttcagcagaaaccagggaaagcccctaagtccctgatctatgctgcatccagtttgcaaagtggggtcccatcaaagttcagcggcaatagatctgggacagatttcactctcaccatcagcagcctgcagcctgaagattttgcaacttattactgccaacaatatagtacttacccgctcactttcggcggagggaccaaggtggagatcaaa

SEQ ID NO: 26910 - protein, 107 aa, Artificial Sequence
  Description of Artificial Sequence: Synthetic polypeptide
DIQMTQSPSSLSASVGDRVTITCRASQGIGNYLAWFQQKPGKAPKSLIYAASSLQSGVPSKFSGNRSGTDFTLTISSLQPEDFATYYCQQYSTYPLTFGGGTKVEIK

SEQ ID NO: 26911 - DNA, 321 bp, Artificial Sequence; identical to SEQ ID NO: 24159
  Description of Artificial Sequence: Synthetic polynucleotide

SEQ ID NO: 26912 - protein, 107 aa, Artificial Sequence; identical to SEQ ID NO: 24160
  Description of Artificial Sequence: Synthetic polypeptide

SEQ ID NO: 26913 - DNA, 336 bp, Artificial Sequence
  Description of Artificial Sequence: Synthetic polynucleotide
gatattgtgttgacccagactccactctctctgtccgtcacccctggacagccggcctccatatcgtgcaagtctagtcagagcctcctctatagtgatggaaggacctatttgtattggtacctgcagaaaccaggccagcctccacaggtcctgatctgtgaggtttccaaccggttctctggagtgccagataggttcagtggcagcgggtcagggacagatttcacactgaaaatcagccgggtggaggcaggagatgttggggtttattactgcatgcaaagtatacagcttccctggacgttcggccaagggaccaaggtggaaatcaaa

SEQ ID NO: 26914 - protein, 112 aa, Artificial Sequence
  Description of Artificial Sequence: Synthetic polypeptide
DIVLTQTPLSLSVTPGQPASISCKSSQSLLYSDGRTYLYWYLQKPGQPPQVLICEVSNRFSGVPDRFSGSGSGTDFTLKISRVEAGDVGVYYCMQSIQLPWTFGQGTKVEIK

SEQ ID NO: 26915 - DNA, 324 bp, Artificial Sequence; identical to SEQ ID NO: 26625
  Description of Artificial Sequence: Synthetic polynucleotide

SEQ ID NO: 26916 - protein, 108 aa, Artificial Sequence; identical to SEQ ID NO: 26626
  Description of Artificial Sequence: Synthetic polypeptide

SEQ ID NO: 26917 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattcgcagcagcttcttagcctggtaccagcagaaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtaactcaccgtgggcgttcggccaagggaccaaggtggaaatcaaa

SEQ ID NO: 26918 - protein, 108 aa, Artificial Sequence
  Description of Artificial Sequence: Synthetic polypeptide
EIVLTQSPGTLSLSPGERATLSCRASQSIRSSFLAWYQQKPGQAPRLLIYGASSRATGIPDRFSGSGSGTDFTLTINRLEPEDFAVYYCQQYGNSPWAFGQGTKVEIK

SEQ ID NO: 26919 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatttcttctgcatccagtttgcaaaggggggtcccatcaagattcagcggcagtggatctgggacagaattcactctcacaatcagcagcctgcagcctgaagattttgcaacttattactgtctacagcataaaaggtacccgctcactttcggcggagggaccaaggtggagatcaaa

SEQ ID NO: 26920 - protein, 107 aa, Artificial Sequence
  Description of Artificial Sequence: Synthetic polypeptide
DIQMTQSPSSLSASVGDRVTITCRASQGIRNDLGWYQQKPGKAPKRLISSASSLQRGVPSRFSGSGSGTEFTLTISSLQPEDFATYYCLQHKRYPLTFGGGTKVEIK

SEQ ID NO: 26921 - DNA, 321 bp, Artificial Sequence
  Description of Artificial Sequence: Synthetic polynucleotide
gacatccagatgacacagtctccatcctcactgtctgcatctgtaggagacagagtcaccatcacttgtcgggcgagtcagggcattagcaagtatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcagcttattactgccaacagtatcttacttacccgctcactttcggcggagggaccaaggtggagatcaaa

SEQ ID NO: 26922 - protein, 107 aa, Artificial Sequence
  Description of Artificial Sequence: Synthetic polypeptide
DIQMTQSPSSLSASVGDRVTITCRASQGISKYLAWFQQKPGKAPKSLIYAASSLQSGVPSKFSGSGSGTDFTLTISSLQPEDFAAYYCQQYLTYPLTFGGGTKVEIK

SEQ ID NO: 26923 - DNA, 321 bp, Artificial Sequence
  Description of Artificial Sequence: Synthetic polynucleotide
gacatagtgatgacgcagtctccagccaccctgtctgtgtctccaggggatagagccaccctctcctgcaggcccagtcagagttttagcagaaacttagcctggtaccagcagaaacctggccaggctcccaggctcctcatctatggtgcatccactagggccactggtatcccagccaggttcagtggcagtgggtctgggacagagttcactctcaccatcagcagcctggagtgtgaagattttgcagtttactactgtcagcagtataataactggccgctcactttcggcggagggaccaaggtggagatcaaa

SEQ ID NO: 26924 - protein, 107 aa, Artificial Sequence
  Description of Artificial Sequence: Synthetic polypeptide
DIVMTQSPATLSVSPGDRATLSCRPSQSFSRNLAWYQQKPGQAPRLLIYGASTRATGIPARFSGSGSGTEFTLTISSLECEDFAVYYCQQYNNWPLTFGGGTKVEIK

SEQ ID NO: 26925 - DNA, 321 bp, Artificial Sequence; identical to SEQ ID NO: 24159
  Description of Artificial Sequence: Synthetic polynucleotide

SEQ ID NO: 26926 - protein, 107 aa, Artificial Sequence; identical to SEQ ID NO: 24160
  Description of Artificial Sequence: Synthetic polypeptide

SEQ ID NO: 26927 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtataaggaccaacttcttagcctggtaccagcagaaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtaactcaccgtggacgttcggccaagggaccaaggtggaaatcaaa

SEQ ID NO: 26928 - protein, 108 aa, Artificial Sequence
  Description of Artificial Sequence: Synthetic polypeptide
EIVLTQSPGTLSLSPGERATLSCRASQSIRTNFLAWYQQKPGQAPRLLIYGASSRATGIPDRFSGSGSGTDFTLTINRLEPEDFAVYYCQQYGNSPWTFGQGTKVEIK

SEQ ID NO: 26929 - DNA, 324 bp, Artificial Sequence
  Description of Artificial Sequence: Synthetic polynucleotide
gaaattgtggtgacgcagtctccaggcaccctgtctttgtctccaggggaaagagccaccctctcctgcagggccagtcagagtgttagaagcagctacttagcctggtaccagcagaaacctggccaggctcccaggctcctcatctatggtgcattcagcagggccactggcatcccagacaggttcagtggcagtgggtctgggacagacttcactctcaccatcagcagactggagcctgaagattttgcagtgtactactgtcagcagtatggtaactcaccgtggacgttcggccacgggaccaaggtggaaatcaaa

SEQ ID NO: 26930 - protein, 108 aa, Artificial Sequence
  Description of Artificial Sequence: Synthetic polypeptide
EIVVTQSPGTLSLSPGERATLSCRASQSVRSSYLAWYQQKPGQAPRLLIYGAFSRATGIPDRFSGSGSGTDFTLTISRLEPEDFAVYYCQQYGNSPWTFGHGTKVEIK

SEQ ID NO: 26931 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattagcagctatttaaattggtttcagcagaaaccagggaaagcccctaagctcctgatctatgctgagtccagtttacaaagtggggtcccatcaaggttcagtggcagtggatctgggacagatttcactctcaccatcagcagtctgcaacctgaagattttgcaacttattcctgtcaacagagttacagttcccctccgtggacgttcggccaagggaccaaggtggagttcaaa

SEQ ID NO: 26932 - protein, 108 aa, Artificial Sequence
  Description of Artificial Sequence: Synthetic polypeptide
DIQMTQSPSSLSASVGDRVTITCRASQSISSYLNWFQQKPGKAPKLLIYAESSLQSGVPSRFSGSGSGTDFTLTISSLQPEDFATYSCQQSYSSPPWTFGQGTKVEFK

SEQ ID NO: 26933 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttatcactgtctacagcattatcgttacccattcactttcggccctgggaccaaagtggatatcaaa

SEQ ID NO: 26934 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYAASSLQSGVPSRFSGSGSGTEFTLTISSLQPEDFATYHCLQHYRYPFTFGPGTKVDIK

SEQ ID NO: 26935 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagaacattggtaataccttgcactggtaccagcagaaaccagatcagtctcctaagctcctcatcaagtatgcttcccagtccttctcaggggtcccctcgaggttcagtggcagtgggtctgggacagatttcatcctcaccatcaatagcctggaagctgaagatgctgcaacgtattactgtcatcagagtggtagtttacctcagacgttcggccaagggaccaaggtggaaatcaaa

SEQ ID NO: 26936 - protein, 107 aa, Artificial Sequence
  Description of Artificial Sequence: Synthetic polypeptide
EIVLTQSPDFQSVTPKEKVTITCRASQNIGNTLHWYQQKPDQSPKLLIKYASQSFSGVPSRFSGSGSGTDFILTINSLEAEDAATYYCHQSGSLPQTFGQGTKVEIK

SEQ ID NO: 26937 - DNA, 339 bp, Artificial Sequence
  Description of Artificial Sequence: Synthetic polynucleotide
gacatcgtgatgacccagtctccagactccccgactgcgtctctgggcgagagggccaccgtcaaatgcaagtccagccagagtgttttacacagctccaacaataacaactacttagcttggtaccagcagaaaccaggacagcctcctaagctgctcatttactgggcatctacccgggaatccggagtccctgaccgattcagtggcagcgggtctgggacagatttcactctcgccatcagcagcctgcaggctgaagatgtggcggtttattactgtcagcaatattataatactcctccgacattcggccaagggaccaaggtggaaatcaaa

SEQ ID NO: 26938 - protein, 113 aa, Artificial Sequence
  Description of Artificial Sequence: Synthetic polypeptide
DIVMTQSPDSPTASLGERATVKCKSSQSVLHSSNNNNYLAWYQQKPGQPPKLLIYWASTRESGVPDRFSGSGSGTDFTLAISSLQAEDVAVYYCQQYYNTPPTFGQGTKVEIK

SEQ ID NO: 26939 - DNA, 321 bp, Artificial Sequence; identical to SEQ ID NO: 26593
  Description of Artificial Sequence: Synthetic polynucleotide

SEQ ID NO: 26940 - protein, 107 aa, Artificial Sequence; identical to SEQ ID NO: 26594
  Description of Artificial Sequence: Synthetic polypeptide

SEQ ID NO: 26941 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaactcagggcattagaaaagatttaggctggtatcagcagaaaccagggaaagcccctaagcgcctgatccatactgcatccagtttgcaaagtggggtcccattaaggttcagcggcagtggatctgggacagaattcactctcacaatcagcagcctgcagcctgaagattttgcaacttattactgtctacagcataatagttacccgtggacgttcggccaagggaccaaggtggaaatcaaa

SEQ ID NO: 26942 - protein, 107 aa, Artificial Sequence
  Description of Artificial Sequence: Synthetic polypeptide
DIQMTQSPSSLSASVGDRVTITCRATQGIRKDLGWYQQKPGKAPKRLIHTASSLQSGVPLRFSGSGSGTEFTLTISSLQPEDFATYYCLQHNSYPWTFGQGTKVEIK

SEQ ID NO: 26943 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagaatattcgcagcagcttcttagcctggtaccaacagaaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtaactcaccgtgggcgttcggccaagggaccaaggtggaaatcaaa

SEQ ID NO: 26944 - protein, 108 aa, Artificial Sequence
  Description of Artificial Sequence: Synthetic polypeptide
EIVLTQSPGTLSLSPGERATLSCRASQNIRSSFLAWYQQKPGQAPRLLIYGASSRATGIPDRFSGSGSGTDFTLTINRLEPEDFAVYYCQQYGNSPWAFGQGTKVEIK

SEQ ID NO: 26945 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggagagcccctaagcgcctgatctattctgcatccagtttgcatactggggtcccatcaaggttcagcggcagtggatctgggacagaattcactctcacaatcagcagcctgcagcctgaagattttgcaacttattactgtctacagcataagagttacccgctcactttcggcggagggaccaaggtggagatcaaa

SEQ ID NO: 26946 - protein, 107 aa, Artificial Sequence
  Description of Artificial Sequence: Synthetic polypeptide
DIQMTQSPSSLSASVGDRVTITCRASQGIRNDLGWYQQKPGRAPKRLIYSASSLHTGVPSRFSGSGSGTEFTLTISSLQPEDFATYYCLQHKSYPLTFGGGTKVEIK

SEQ ID NO: 26947 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattaggaatgatttaggctggtatcagcagaaaccagggaaagcccctaagcgcctgatctattctgcatccattttacaaaggggggtcccatcaaggttcagcggcagtggatctgggacagaattcactctcacaatcagcagcctgcagcctgaagattttgcaacttattactgtctacagcataaaagttaccctctcactttcggcggagggaccaaggtggaggtcaaa

SEQ ID NO: 26948 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYSASILQRGVPSRFSGSGSGTEFTLTISSLQPEDFATYYCLQHKSYPLTFGGGTKVEVK

SEQ ID NO: 26949 - DNA, 324 bp, Artificial Sequence
  Description of Artificial Sequence: Synthetic polynucleotide
gaaattgtgttgacgcagtctccagacaccctgtctttgtctccaggggaaagagccaccctctcctgcagggccagtccgagtattaacagcggcttcttagcctggtaccagcagaaacctggccaagctcccaggctcctcatctatggtgcatccagcagggccactggcatcccagacaggttcagtggcagtgggtctgggacagacttcactctcaccatcagcagactggagcctgaagattttgcaatgtttcactgtcaccagtatgagacctcaccgtggacgttcggccaagggaccaaggtggagatcaaa

SEQ ID NO: 26950 - protein, 108 aa, Artificial Sequence
  Description of Artificial Sequence: Synthetic polypeptide
EIVLTQSPDTLSLSPGERATLSCRASPSINSGFLAWYQQKPGQAPRLLIYGASSRATGIPDRFSGSGSGTDFTLTISRLEPEDFAMFHCHQYETSPWTFGQGTKVEIK

SEQ ID NO: 26951 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcaactccaacatcggaagtaatattgtaacctggtaccagcagctcccaggaacggcccccaaactcctcatctatagtaatgatcagcggccctcaggggtccctgaccgattctctggctccaagtctggcacctcagcctccctggccatcagtgggctccagtctgaggatgaggctgattattactgtacagcatgggatgacagcctgaatggttgggtgttcggcggaggtaccacgctgaccgtccta

SEQ ID NO: 26952 - protein, 110 aa, Artificial Sequence
  Description of Artificial Sequence: Synthetic polypeptide
QSVLTQPPSASGTPGQRVTISCSGSNSNIGSNIVTWYQQLPGTAPKLLIYSNDQRPSGVPDRFSGSKSGTSASLAISGLQSEDEADYYCTAWDDSLNGWVFGGGTTLTVL

SEQ ID NO: 26953 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagaatattaaaaacaacttagcctggtaccagcagaaacctggccaggctcccaggctcctcatctttggtgcatccaccagggccactggtatcccagccaggttcagtggcagtgggtctgggacagagttcactctcaccatcagcagcctgcagtctgaagattttgcagtttattactgtcagcagttttataactggctgtgcagttttggccaggggaccaagctggagctcaaa

SEQ ID NO: 26954 - protein, 107 aa, Artificial Sequence
  Description of Artificial Sequence: Synthetic polypeptide
EIVMTQSPATLSVSPGERATLSCRASQNIKNNLAWYQQKPGQAPRLLIFGASTRATGIPARFSGSGSGTEFTLTISSLQSEDFAVYYCQQFYNWLCSFGQGTKLELK

SEQ ID NO: 26955 - DNA, 324 bp, Artificial Sequence
  Description of Artificial Sequence: Synthetic polynucleotide
gaaattgttttgacgcagtctccaggcaccctgtctttgtctccaggggaaagagccaccctctcctgcagggccagtcagagtgttagcagcaactacttagcctggtatcagcagagacctggccaggctcccagactcctcatctatggtgcatccagcagggccactggcatcccagacagattcagtggcagtgggtctgggacagacttcactctcaccatcagcagactggagcctgaagattttgcagtgtatttctgtcagcagtatgaaaactcaccgtggacgttcggccaagggaccaaggtggaaatcaaa

SEQ ID NO: 26956 - protein, 108 aa, Artificial Sequence
  Description of Artificial Sequence: Synthetic polypeptide
EIVLTQSPGTLSLSPGERATLSCRASQSVSSNYLAWYQQRPGQAPRLLIYGASSRATGIPDRFSGSGSGTDFTLTISRLEPEDFAVYFCQQYENSPWTFGQGTKVEIK

SEQ ID NO: 26957 - DNA, 321 bp, Artificial Sequence
  Description of Artificial Sequence: Synthetic polynucleotide
gaaattgtgctgactcagtctccagcctttcagtctgtgactccaaaggagaaagtcaccatcacctgccgggccagtcagaacattggtcgtagtttacactggtaccagcagaaaccagatcagtctccaaaactcctcatcaagtatgcttcccagtccttctcaggggtcccctcgaggttcagtggcagtggatctgggacaaatttcaccctcaccatcaatagcctggaagctgaagatgctgtaacgtattactgtcatcagagtcgaagtttaccgctcactttcggcggagggaccaaggtagagatcaga

SEQ ID NO: 26958 - protein, 107 aa, Artificial Sequence
  Description of Artificial Sequence: Synthetic polypeptide
EIVLTQSPAFQSVTPKEKVTITCRASQNIGRSLHWYQQKPDQSPKLLIKYASQSFSGVPSRFSGSGSGTNFTLTINSLEAEDAVTYYCHQSRSLPLTFGGGTKVEIR

SEQ ID NO: 26959 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggagagcccctaagcgcctgatctattctacatccagtttgcattctggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 26960 - protein, 107 aa, Artificial Sequence
  Description of Artificial Sequence: Synthetic polypeptide
DIQMTQSPSSLSASVGDRVTITCRASQGIRNDLGWYQQKPGRAPKRLIYSTSSLHSGVPSRFSGSGSGTEFTLTISSLQPEDFATYYCLQHNSYPLTFGGGTKVEIK

SEQ ID NO: 26961 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcacaacattaacagctatttaaattggtatcagcagaaatcagggaaagcccctaaactcctaatctatgctgcatccagtttgcaaagtggggtcccgtcaaggttcagtggcagtggatctgggacagatttcactctcaccttcagtagtctacaacctgaagattttgcaacttactactgtcaacagagttacagtttcccgctcactttcggcggagggaccaaggtggagatgagg

SEQ ID NO: 26962 - protein, 107 aa, Artificial Sequence
  Description of Artificial Sequence: Synthetic polypeptide
DIQMTQSPSSLSASVGDRVTITCRASHNINSYLNWYQQKSGKAPKLLIYAASSLQSGVPSRFSGSGSGTDFTLTFSSLQPEDFATYYCQQSYSFPLTFGGGTKVEMR

SEQ ID NO: 26963 - DNA, 333 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctccataataatagatacaaccatttggattggtacctgcagaagccaggacagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccactttcggcggagggaccaaggtggagatcaaa

SEQ ID NO: 26964 - protein, 111 aa, Artificial Sequence
  Description of Artificial Sequence: Synthetic polypeptide
DIVMTQSPLSLPVTPGEPASISCRSSQSLLHNNRYNHLDWYLQKPGQSPQLLIYLGSNRASGVPDRFSGSGSGTDFTLKISRVEAEDVGVYYCMQALQTPTFGGGTKVEIK

SEQ ID NO: 26965 - DNA, 321 bp, Artificial Sequence
  Description of Artificial Sequence: Synthetic polynucleotide
gacatccagatgtcccaatctccatcctccctgtctgcatctgttggagacagagtcaccatcacttgccgggcaagtcagggcattagaaatgatttaggctggtatcagcagaaaccagggaaagcccctaagcgcctgatctgtgctgcatccaggttgcaaagtggggtcccatcaaggttcagcggcagtggatctgggacagaattcactctcacaatcagcagcctgcagcctgaagattttgcaatttattactgtctacagcatcatgactacccattcactttcggccctgggaccaaagtggatatcaaa

SEQ ID NO: 26966 - protein, 107 aa, Artificial Sequence
  Description of Artificial Sequence: Synthetic polypeptide
DIQMSQSPSSLSASVGDRVTITCRASQGIRNDLGWYQQKPGKAPKRLICAASRLQSGVPSRFSGSGSGTEFTLTISSLQPEDFAIYYCLQHHDYPFTFGPGTKVDIK

SEQ ID NO: 26967 - DNA, 321 bp, Artificial Sequence
  Description of Artificial Sequence: Synthetic polynucleotide
gaaatagtgatgacgcagtctccagccaccctgtctgtgtctccaggggaaagtgccaccctctcctgcaggtccagtcagaatattaaaagcaacttagcctggtaccagcagaaacctggccaggctcccaggctcctcatctttggtgcatccaccagggccactggtatcccagccaggttcagtggcagtgggtctgggacagagttcactctcaccatcagcagcctgcagtctgaagattttgcagtttattactgtcagcagttttataactggctgtgcagttttggccaggggaccaagctggagctcaaa

SEQ ID NO: 26968 - protein, 107 aa, Artificial Sequence
  Description of Artificial Sequence: Synthetic polypeptide
EIVMTQSPATLSVSPGESATLSCRSSQNIKSNLAWYQQKPGQAPRLLIFGASTRATGIPARFSGSGSGTEFTLTISSLQSEDFAVYYCQQFYNWLCSFGQGTKLELK

SEQ ID NO: 26969 - DNA, 321 bp, Artificial Sequence
  Description of Artificial Sequence: Synthetic polynucleotide
gaaatagtgatgacgcagtcaccagccaccctgtctgtgtctccaggggaaagagccaccctctcctgcagggccagtcagagaattaacaacaacttagcctggtaccagcagaaccctggccaggctcccaggctcctcatttatggtgcatccaccagggccactggtgtcccggccaggttcagtggcagtgggtctgggacagagttcactctcaccatcagcagcctgcagtctgaagactttacagtttattactgtcagcagtattataactggctgtgcagttttggccaggggaccaagctggagatcaga

SEQ ID NO: 26970 - protein, 107 aa, Artificial Sequence
  Description of Artificial Sequence: Synthetic polypeptide
EIVMTQSPATLSVSPGERATLSCRASQRINNNLAWYQQNPGQAPRLLIYGASTRATGVPARFSGSGSGTEFTLTISSLQSEDFTVYYCQQYYNWLCSFGQGTKLEIR

SEQ ID NO: 26971 - DNA, 333 bp, Artificial Sequence
  Description of Artificial Sequence: Synthetic polynucleotide
gatattgtgctgactcagtctccactctccctgcccgtcacccctggagagccggcctccatctcctgcaggtctagtcagagcctcctgcataataataaatacaaccatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccactttcggcggagggaccaaggtggagatcaaa

SEQ ID NO: 26972 - protein, 111 aa, Artificial Sequence
  Description of Artificial Sequence: Synthetic polypeptide
DIVLTQSPLSLPVTPGEPASISCRSSQSLLHNNKYNHLDWYLQKPGQSPQLLIYLGSNRASGVPDRFSGSGSGTDFTLKISRVEAEDVGVYYCMQALQTPTFGGGTKVEIK

SEQ ID NO: 26973 - DNA, 324 bp, Artificial Sequence
  Description of Artificial Sequence: Synthetic polynucleotide
gaaattgtgttgacgcagtctccagacaccctgtctttgtctccaggggaaagagccaccctctcctgcagggccagtcagagtgttaacagcggctacttagcctggtaccagcagaaacctggccagtctcccaggctcctcatctatggtgcatccagcagggccactggcatcccagacaggttcagtggcagtgggtctgggacagacttcactctcaccatcagcagactggagcctgaagattttgcagtgcattactgtcaacaatatgagacctcaccgtggacgttcggccaagggaccaaggtggaaatcaaa

SEQ ID NO: 26974 - protein, 108 aa, Artificial Sequence
  Description of Artificial Sequence: Synthetic polypeptide
EIVLTQSPDTLSLSPGERATLSCRASQSVNSGYLAWYQQKPGQSPRLLIYGASSRATGIPDRFSGSGSGTDFTLTISRLEPEDFAVHYCQQYETSPWTFGQGTKVEIK

SEQ ID NO: 26975 - DNA, 324 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttctgaacaacttagcctggtaccagcagagacctggccaggctcccaggctcctcatctatggtgcatccactagggccactggtatcccagccaggttcagtggcagtgggtctgggacagagttcactctcaccatcagcagcctgcagtctgaagattttgcagtttattactgtcagcagtatgataactggcctccgtgcagttttggccaggggaccaagctggagatcaaa

SEQ ID NO: 26976 - protein, 108 aa, Artificial Sequence
  Description of Artificial Sequence: Synthetic polypeptide
EIVMTQSPATLSVSPGERATLSCRASQSVLNNLAWYQQRPGQAPRLLIYGASTRATGIPARFSGSGSGTEFTLTISSLQSEDFAVYYCQQYDNWPPCSFGQGTKLEIK

SEQ ID NO: 26977 - DNA, 321 bp, Artificial Sequence
  Description of Artificial Sequence: Synthetic polynucleotide
gacatccagatgacccagtctccatcctcactgtctgcatctgtcggagacagagtcaccatcacttgtcgggcgagtcagggcattggcaattatttagcctggtttcagcagaaaccagggaaagcccctaagtccctgatctatgttgcatccaggttgcaaagtggggtcccatcaaagttcagcggcactggatctgggtcagatttcactctcaccatcagcagcctgcagcctgacgattttgcgacttattactgccaacggtatcatacttacccgctcactttcggcggagggaccaaggtggagatcaaa

SEQ ID NO: 26978 - protein, 107 aa, Artificial Sequence
  Description of Artificial Sequence: Synthetic polypeptide
DIQMTQSPSSLSASVGDRVTITCRASQGIGNYLAWFQQKPGKAPKSLIYVASRLQSGVPSKFSGTGSGSDFTLTISSLQPDDFATYYCQRYHTYPLTFGGGTKVEIK

SEQ ID NO: 26979 - DNA, 321 bp, Artificial Sequence
  Description of Artificial Sequence: Synthetic polynucleotide
gacatccagatgacccagtctccatcctccccgtctgcatctgttggagacagagtcaccatcactcgccgggcaagtcacaacattaacagctatttaaattggtatcagcagaaatcagggaaagcccctaaactccttatctatgctgcatccagtttgcaaagtggggtcccgtcaaggttcagtggcagtggatctgggacagatttcactctcactttcagtagtctacaacctgaagattttgcaacttactactgtcaacagagttacagtttcccgctcactttcggcggagggaccaaggtggagatgagg

SEQ ID NO: 26980 - protein, 107 aa, Artificial Sequence
  Description of Artificial Sequence: Synthetic polypeptide
DIQMTQSPSSPSASVGDRVTITRRASHNINSYLNWYQQKSGKAPKLLIYAASSLQSGVPSRFSGSGSGTDFTLTFSSLQPEDFATYYCQQSYSFPLTFGGGTKVEMR

SEQ ID NO: 26981 - DNA, 321 bp, Artificial Sequence
  Description of Artificial Sequence: Synthetic polynucleotide
gacatccagatgacccagtctccatcctcccgttttgcatctgtaggagacagagtcaccatcacttgccgggcaagtcagggcattagacatgatttaggctggtatcagcagaaaccagggaaagcccttaagcgcttgatatatgctgcatccagtttgcaaagtggggtcccatcaaggttcagcggcagtggatgtgggacagaattcactctcacaatcagcagcgtgcagcctgaagattttgcaaattattactgtctacagcattatagtttccctcggacgttcggccaagggaccaaggtggaaatcaaa

SEQ ID NO: 26982 - protein, 107 aa, Artificial Sequence
  Description of Artificial Sequence: Synthetic polypeptide
DIQMTQSPSSRFASVGDRVTITCRASQGIRHDLGWYQQKPGKALKRLIYAASSLQSGVPSRFSGSGCGTEFTLTISSVQPEDFANYYCLQHYSFPRTFGQGTKVEIK

SEQ ID NO: 26983 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatagggcatccagtgtgcaaaatggggtcccatcaaggttcagcggcagtggatctgggacagaattcactctcacaatcagcagcctgcagcctgaagattttgcaacttatcactgtctacagcataatagttacccattcactttcggccctgggaccaaagtggatatcaaa

SEQ ID NO: 26984 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYRASSVQNGVPSRFSGSGSGTEFTLTISSLQPEDFATYHCLQHNSYPFTFGPGTKVDIK

SEQ ID NO: 26985 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgtttttttccactcgaacaataagaactacttagcttggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtgacagtttattactgtcaacaatattttagtcttccattcactttcggccctgggaccaaagtggatatcaca

SEQ ID NO: 26986 - protein, 113 aa, Artificial Sequence
  Description of Artificial Sequence: Synthetic polypeptide
DIVMTQSPDSLAVSLGERATINCKSSQSVFFHSNNKNYLAWYQQKPGQPPKLLIYWASTRESGVPDRFSGSGSGTDFTLTISSLQAEDVTVYYCQQYFSLPFTFGPGTKVDIT

SEQ ID NO: 26987 - DNA, 339 bp, Artificial Sequence
  Description of Artificial Sequence: Synthetic polynucleotide
gacatcgtgatgacccagtctccagagtccctggctgtgtctctgggcgagagggccaccatcaactgcaagtccagccagagtgttttatacagttccaacaataagaactacttagtttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaa

SEQ ID NO: 26988 - protein, 113 aa, Artificial Sequence
  Description of Artificial Sequence: Synthetic polypeptide
DIVMTQSPESLAVSLGERATINCKSSQSVLYSSNNKNYLVWYQQKPGQPPKLLIYWASTRESGVPDRFSGSGSGTDFTLTISSLQAEDVAVYYCQQYYSTPPTFGQGTKVEIK

SEQ ID NO: 26989 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctgaactcctgatctatgctgcagccagtttgcaaggtggggtcccatcaaggttcagcggcagtggatctgggacagaattcactctcacaatcagcagcctgcagcctgaagattttgcaacttattactgtctacagcattatagttaccctcggacgttcggccaagggaccaaggtggaactccaa

SEQ ID NO: 26990 - protein, 107 aa, Artificial Sequence
  Description of Artificial Sequence: Synthetic polypeptide
DIQMTQSPSSLSASVGDRVTITCRASQGIRNDLGWYQQKPGKAPELLIYAAASLQGGVPSRFSGSGSGTEFTLTISSLQPEDFATYYCLQHYSYPRTFGQGTKVELQ

SEQ ID NO: 26991 - DNA, 321 bp, Artificial Sequence
  Description of Artificial Sequence: Synthetic polynucleotide
gacatccagatgaccctgtctccatcctccccgtctgcatttgttggagacagagtcaccatcactcgccgggcaagtcacaacattaacagctatttaaattggtatcagcagaaatcagggaaagcccctaaactccttatctatgctgcatccagtttgcaaagtggggtcccgtcaaggttcagtggcagtggatctgggacagatttcactctcactttcagtagtctacaacctgaagattttgcaacttactactgtcaacagagttacagtttcccgctcactttcggcggagggaccaaggtggagatgagg

SEQ ID NO: 26992 - protein, 107 aa, Artificial Sequence
  Description of Artificial Sequence: Synthetic polypeptide
DIQMTLSPSSPSAFVGDRVTITRRASHNINSYLNWYQQKSGKAPKLLIYAASSLQSGVPSRFSGSGSGTDFTLTFSSLQPEDFATYYCQQSYSFPLTFGGGTKVEMR

SEQ ID NO: 26993 - DNA, 321 bp, Artificial Sequence
  Description of Artificial Sequence: Synthetic polynucleotide
gagatagtgatgacgcagtctccagccaccctgtctgtgtctccaggggaaagagccaccctctcctgcagggccagtcagaatattaaaagcaacttagcctggtaccagcagaaacctggccaggctcccaggctcctcatctttggtgcatccaccagggccactggtatcccagccaggttcagtggcagtgggtctggtacagagttcactctcaccatcagcagcctgcagtctgaagattttgcagtgtattactgtcagcagttttataactggctgtgcagttttggccaggggaccaagctggagctcaag

SEQ ID NO: 26994 - protein, 107 aa, Artificial Sequence
  Description of Artificial Sequence: Synthetic polypeptide
EIVMTQSPATLSVSPGERATLSCRASQNIKSNLAWYQQKPGQAPRLLIFGASTRATGIPARFSGSGSGTEFTLTISSLQSEDFAVYYCQQFYNWLCSFGQGTKLELK

SEQ ID NO: 26995 - DNA, 321 bp, Artificial Sequence
  Description of Artificial Sequence: Synthetic polynucleotide
gacagccagatgacccagtctccatcctccctgtctgcatctgtaggagacagagtcaccatcacttgccgggcaagtcggagcgttcacacctatttaaattggtatcaacagaagccagggaaagcccctaaggtcctgatctatggtgcatccagtttgcaacgtggggtcccatcaaggttcagtggcagtggatctgggacagatttcactctcaccatcagcagtctgcaacctgaagatgttgcaacttactactgtcaacagagttacagttccccgctcactttcggcggggggaccaaggtggagatccaa

SEQ ID NO: 26996 - protein, 107 aa, Artificial Sequence
  Description of Artificial Sequence: Synthetic polypeptide
DSQMTQSPSSLSASVGDRVTITCRASRSVHTYLNWYQQKPGKAPKVLIYGASSLQRGVPSRFSGSGSGTDFTLTISSLQPEDVATYYCQQSYSSPLTFGGGTKVEIQ

SEQ ID NO: 26997 - DNA, 321 bp, Artificial Sequence
  Description of Artificial Sequence: Synthetic polynucleotide
gacatccggatgacccagtctccatcctcactgtctgcatctgtaggagacagaatcaccatcacttgtcggacgagtcagggcattggcaattatttagcctggtttcagcagaaaccagggaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacactatcttagttaccctctcactttcggcggagggaccaaggtggagatcaaa

SEQ ID NO: 26998 - protein, 107 aa, Artificial Sequence
  Description of Artificial Sequence: Synthetic polypeptide
DIRMTQSPSSLSASVGDRITITCRTSQGIGNYLAWFQQKPGKAPKSLIYAASSLQSGVPSRFSGSGSGTDFTLTISSLQPEDFATYYCQHYLSYPLTFGGGTKVEIK

SEQ ID NO: 26999 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcataagtaatcatttagcctggtttcagcagaaaccagggaaagcccctaagtccctgatctttgctgcatccagtttgcaaagtggggtcccatcacagttcagcggcagtggatctgggaccgaattcactctcaccatcagcagcctgcagcctgaagattttgcaacttattactgccaacagtatagtaattacccggtcactttcggcggagggaccaaggtggagatcaaa

SEQ ID NO: 27000 - protein, 107 aa, Artificial Sequence
  Description of Artificial Sequence: Synthetic polypeptide
DIQMTQSPSSLSASVGDRVTITCRASQGISNHLAWFQQKPGKAPKSLIFAASSLQSGVPSQFSGSGSGTEFTLTISSLQPEDFATYYCQQYSNYPVTFGGGTKVEIK

SEQ ID NO: 27001 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctattctgcatccagtttgcaaagtggggtcccatcaaggttcagcggccgtggatctgggacagaattcactctcacagtcagcagcctgcagcctgaagattttgcaacttattactgtctacaacataatagttaccctctcactttcggcggagggaccaaggtggagatcaaa

SEQ ID NO: 27002 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYSASSLQSGVPSRFSGRGSGTEFTLTVSSLQPEDFATYYCLQHNSYPLTFGGGTKVEIK

SEQ ID NO: 27003 - DNA, 324 bp, Artificial Sequence
  Description of Artificial Sequence: Synthetic polynucleotide
gaaatcgtgttgacgcagtctccaggcaccctgtctttgtctccaggggaaagagccaccctctcctgcagggccagtcagaatgttagttacagctacttagcctggtaccagcagaaacctggccaggctcccaggctcctcatctatggtgcatccaggagggccactggcatcccagacaggttcagtggcagtgggtctgggacagacttcactctcaccatcagcagactggagcctgaagattttgcagtgtattactgtcagcagtatggtagctcaccgtgcagttttggccaggggaccaagctggagatcaaa

SEQ ID NO: 27004 - protein, 108 aa, Artificial Sequence
  Description of Artificial Sequence: Synthetic polypeptide
EIVLTQSPGTLSLSPGERATLSCRASQNVSYSYLAWYQQKPGQAPRLLIYGASRRATGIPDRFSGSGSGTDFTLTISRLEPEDFAVYYCQQYGSSPCSFGQGTKLEIK

SEQ ID NO: 27005 - DNA, 321 bp, Artificial Sequence
  Description of Artificial Sequence: Synthetic polynucleotide
gacatcccgatgacccagtctccatcctcactgtctgcatctgtaggagacagagtcaccatcacttgtcgggcgagtcaggccattagtaatcatttagcctggtttcagctgaaaccagggaaagcccctaagtccctgatctatgctgcatccagtttgcaaagtggggtcccatcaaagttcagcggcagtggatctgggtcagatttcactctcaccatcagcagcctgcagcctgaagattttgcaacttattactgccaacaatatagtaattacccactcactttcggcggagggaccaaggtggagatcaaa

SEQ ID NO: 27006 - protein, 107 aa, Artificial Sequence
  Description of Artificial Sequence: Synthetic polypeptide
DIPMTQSPSSLSASVGDRVTITCRASQAISNHLAWFQLKPGKAPKSLIYAASSLQSGVPSKFSGSGSGSDFTLTISSLQPEDFATYYCQQYSNYPLTFGGGTKVEIK

SEQ ID NO: 27007 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagaatattaaaagcaacttagcctggtaccagcagaaacctggccaggctcccaggctcctcatctttggtgcatccaccagggccactggtatcccagccaggttcagtggcagtgggtctgggacagagttcactctcaccatcagcagcctgcagtctgaagattttgcagtttattactgtcagcagttttataactggctgtgcagttttggccaggggaccaagctggagctcaaa

SEQ ID NO: 27008 - protein, 107 aa, Artificial Sequence; identical to SEQ ID NO: 26994
  Description of Artificial Sequence: Synthetic polypeptide

SEQ ID NO: 27009 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaattatttagcctggtttcagcagaaaccagggaaagcccctaagtccctgatctatggtgtctccagtttgcaaagtggggtcccatcaaagttcagcggcagtggatctgggacagatttcactctcaccatcagcagcctgcagcctgaagattttgcaacttatacctgccaacaatatagtaattaccctctcactttcggcggagggaccaaggtggacatcaga

SEQ ID NO: 27010 - protein, 107 aa, Artificial Sequence
  Description of Artificial Sequence: Synthetic polypeptide
DIQMTQSPSSLSASVGDRVTITCRASQGIGNYLAWFQQKPGKAPKSLIYGVSSLQSGVPSKFSGSGSGTDFTLTISSLQPEDFATYTCQQYSNYPLTFGGGTKVDIR

SEQ ID NO: 27011 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttttcagcaactacttagcctggtaccagcagaaacctggccaggctcccaggctcctcatctatggtgcatccagcagggccgctggcatccccgacaggttcagtggcagtgggtctgggacagacttcactctcaccatcagcagactggagcctgaaaattttgcagtgtattactgtcagcagtatgaaagttcaccgtggacgttcggccaagggaccaaggtggaaatcaaa

SEQ ID NO: 27012 - protein, 108 aa, Artificial Sequence
  Description of Artificial Sequence: Synthetic polypeptide
EIVLTQSPGTLSLSPGERATLSCRASQSVFSNYLAWYQQKPGQAPRLLIYGASSRAAGIPDRFSGSGSGTDFTLTISRLEPENFAVYYCQQYESSPWTFGQGTKVEIK

SEQ ID NO: 27013 - DNA, 333 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcataataatagatacaaccatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccactttcggcggagggaccaaggtggagatcaaa

SEQ ID NO: 27014 - protein, 111 aa, Artificial Sequence; identical to SEQ ID NO: 26964
  Description of Artificial Sequence: Synthetic polypeptide

SEQ ID NO: 27015 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttaatagctacttagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcagtttattactgtcaagagtataatgactggccgtgcagttttggccaggggaccaacctggagatcaaa

SEQ ID NO: 27016 - protein, 107 aa, Artificial Sequence
  Description of Artificial Sequence: Synthetic polypeptide
EIVMTQSPATLSVSPGERATLSCRASQSVNSYLAWYQQKPGQAPRLLIYGASTRATGIPARFSGSGSGTEFTLTISSLQSEDFAVYYCQEYNDWPCSFGQGTNLEIK

SEQ ID NO: 27017 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaacaagggaaagcccctaagctcctgatctattctgcatcctttttgcaaagaggggtcccatcaagattcagcggcagtggatctgggacagaattcactctcacaatcagcagcctgcagcctgaagattctgcagcttattactgtctacagcataatagttacccgctcactttcggcggagggaccacggtgaagatcaaa

SEQ ID NO: 27018 - protein, 107 aa, Artificial Sequence
  Description of Artificial Sequence: Synthetic polypeptide
DIQMTQSPSSLSASVGDRVTITCRASQGIRNDLGWYQQKQGKAPKLLIYSASFLQRGVPSRFSGSGSGTEFTLTISSLQPEDSAAYYCLQHNSYPLTFGGGTTVKIK

SEQ ID NO: 27019 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattaacagcaactacttagcctggtaccagcggaagcctggccaggctcccagggtcctcatctatggtgcatccagcagggccactggcatcccagacaggttcagtggcagtgggtctgggacagacttcactctcaccatcagcagactggagcctgaagattttgcagtgttttactgtcagcagtatgaaaactcaccgtggacgttcggccaagggaccaaggtggaaatcaaa

SEQ ID NO: 27020 - protein, 108 aa, Artificial Sequence
  Description of Artificial Sequence: Synthetic polypeptide
EIVLTQSPGTLSLSPGERATLSCRASQSINSNYLAWYQRKPGQAPRVLIYGASSRATGIPDRFSGSGSGTDFTLTISRLEPEDFAVFYCQQYENSPWTFGQGTKVEIK

SEQ ID NO: 27021 - DNA, 321 bp, Artificial Sequence
  Description of Artificial Sequence: Synthetic polynucleotide
gacatccagatgaccctgtctccatcctccccgtctgcatttgttggagacagagtcaccatcactcgccgggcaagtcacaacattaacagctatttaaattggtatcagcagaaatcagggaaagcccctaaactccttatctgtgctgcatccagtttgcaaagtggggtcccgtcaaggttcagtggcagtggatctgggacagatttcactctcactttcagtagtctacaacctgaagattttgcaacttactactgtcaacagagttacagtttcccgctcactttcggcggagggaccaaggtggagatgagg

SEQ ID NO: 27022 - protein, 107 aa, Artificial Sequence
  Description of Artificial Sequence: Synthetic polypeptide
DIQMTLSPSSPSAFVGDRVTITRRASHNINSYLNWYQQKSGKAPKLLICAASSLQSGVPSRFSGSGSGTDFTLTFSSLQPEDFATYYCQQSYSFPLTFGGGTKVEMR

SEQ ID NO: 27023 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagcattggtcgtagcttacactggtaccagcagaaaccagatcagtctccaaaactcctcatcaagtatgcttcccagtccttctcaggggtcccctcgaggttcagtggcagtggatctgggacagatttcaccctcaccatcaatagcctggaagctgaagatgctgcaacgtattactgtcatcagagtagaagtttaccgctcactttcggcggagggaccaaggtggagatcaaa

SEQ ID NO: 27024 - protein, 107 aa, Artificial Sequence
  Description of Artificial Sequence: Synthetic polypeptide
EIVLTQSPDFQSVTPKEKVTITCRASQSIGRSLHWYQQKPDQSPKLLIKYASQSFSGVPSRFSGSGSGTDFTLTINSLEAEDAATYYCHQSRSLPLTFGGGTKVEIK

SEQ ID NO: 27025 - DNA, 321 bp, Artificial Sequence
  Description of Artificial Sequence: Synthetic polynucleotide
gacatccagatgacccagtctccatcctccccgtctgcatctgttggagacagagtcaccatcactcgccgggcaagtcacaacattaacagctatttaaattggtatcagcagaaatcagggaaagcccctaaactccttatctgtgctgcatccagtttgcaaagtggggtcccgtcaaggttcagtggcagtggatctgggacagatttcactctcactttcagtagtctacaacctgaagattttgcaacttactactgtcaacagagttacagtttcccgctcactttcggcggagggaccaaggtggagatgagg

SEQ ID NO: 27026 - protein, 107 aa, Artificial Sequence
  Description of Artificial Sequence: Synthetic polypeptide
DIQMTQSPSSPSASVGDRVTITRRASHNINSYLNWYQQKSGKAPKLLICAASSLQSGVPSRFSGSGSGTDFTLTFSSLQPEDFATYYCQQSYSFPLTFGGGTKVEMR

SEQ ID NO: 27027 - DNA, 321 bp, Artificial Sequence
  Description of Artificial Sequence: Synthetic polynucleotide
gatatccagatgacccagtctccatcctcactgtctgcatctgtaggagacagagtcaccatcacttgtcgggcgagtcagggcattagaaattatttagcctggcttcagcagaaaccagggaaggcccctaagtccctgatccatgctgcatccagtttgcaaagtggggtcccatcaaagttcagcggcaatagatctgggacagatttcactctcaccatcagcagcctgcagcctgaagattttgcaacttattactgccaacagtacagtaattaccctctcactttcggcggagggaccaaggtggagatcaaa

SEQ ID NO: 27028 - protein, 107 aa, Artificial Sequence
  Description of Artificial Sequence: Synthetic polypeptide
DIQMTQSPSSLSASVGDRVTITCRASQGIRNYLAWLQQKPGKAPKSLIHAASSLQSGVPSKFSGNRSGTDFTLTISSLQPEDFATYYCQQYSNYPLTFGGGTKVEIK

SEQ ID NO: 27029 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttatttctgtctacagcataatagttaccctctcaccttcggccaagggacacgactggaaattaaa

SEQ ID NO: 27030 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYFCLQHNSYPLTFGQGTRLEIK

SEQ ID NO: 27031 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagacatgatttaggctggtatcaacagaaaccagggaaagcccctaagcgcctgatctatgctgcatccagtttgcaaagtggggtcccatcagggttcagcggcagtggatctgggacagaattcactctcacaatcagcagcctgcagcctgaagattttgcaacttattactgtctacagcattatagttaccctcggacgttcggccaagggaccaaggtggaaatcaaa

SEQ ID NO: 27032 - protein, 107 aa, Artificial Sequence
  Description of Artificial Sequence: Synthetic polypeptide
DIQMTQSPSSLSASVGDRVTITCRASQGIRHDLGWYQQKPGKAPKRLIYAASSLQSGVPSGFSGSGSGTEFTLTISSLQPEDFATYYCLQHYSYPRTFGQGTKVEIK

SEQ ID NO: 27033 - DNA, 333 bp, Artificial Sequence; identical to SEQ ID NO: 26971
  Description of Artificial Sequence: Synthetic polynucleotide

SEQ ID NO: 27034 - protein, 111 aa, Artificial Sequence; identical to SEQ ID NO: 26972
  Description of Artificial Sequence: Synthetic polypeptide

SEQ ID NO: 27035 - DNA, 324 bp, Artificial Sequence
  Description of Artificial Sequence: Synthetic polynucleotide
gaaattgttttgacgcagtctccaggcaccctgtctttgtctccaggggaaagagccaccctctcctgcagggccagtcagagtgttagcagcaactacttagcctggtatcagcagagacctggccaggctcccagactcctcatctatggtgcatccagcagggccactggcatcccagacagattcagtggcagtgggtctgggacagacttcactctcaccatcagcagactggagcctgaagattttgcagtgtatttctgtcagcactacgaaaactcaccgtggacgttcggccaagggaccaaggtggaaatcaaa

SEQ ID NO: 27036 - protein, 108 aa, Artificial Sequence
  Description of Artificial Sequence: Synthetic polypeptide
EIVLTQSPGTLSLSPGERATLSCRASQSVSSNYLAWYQQRPGQAPRLLIYGASSRATGIPDRFSGSGSGTDFTLTISRLEPEDFAVYFCQHYENSPWTFGQGTKVEIK

SEQ ID NO: 27037 - DNA, 321 bp, Artificial Sequence
  Description of Artificial Sequence: Synthetic polynucleotide
gacatccagatgacccagtctccatcctccccgtctgcatttgttggagacagagtcaccatcactcgccgggcaagtcacaacattaacagctatttaaattggtatcagcagaaatcagggaaagcccctaaactccttatctatgctgcatccagtttgcaaagtggggtcccgtcaaggttcagtggcagtggatctgggacagatttcactctcactttcagtagtctacaacctgaagattttgcaacttactactgtcaacagagttacagtttcccgctcactttcggcggagggaccaaggtggagatgagg

SEQ ID NO: 27038 - protein, 107 aa, Artificial Sequence
  Description of Artificial Sequence: Synthetic polypeptide
DIQMTQSPSSPSAFVGDRVTITRRASHNINSYLNWYQQKSGKAPKLLIYAASSLQSGVPSRFSGSGSGTDFTLTFSSLQPEDFATYYCQQSYSFPLTFGGGTKVEMR

SEQ ID NO: 27039 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcaacaactacttagcctggtaccagcagaaacctggccaggctcccagggtcctcatctatggtgcatccagcagggccactggcatcccagacaggttcagtggcagtgggtctgggacagacttcactctcaccatcagcagactggagcctgaagattttgcagtgtattactgtcagcactatcatagctcaccgtggacgttcggccaagggaccaaggtggaaatcaaa

SEQ ID NO: 27040 - protein, 108 aa, Artificial Sequence
  Description of Artificial Sequence: Synthetic polypeptide
EIVLTQSPGTLSLSPGERATLSCRASQSVSNNYLAWYQQKPGQAPRVLIYGASSRATGIPDRFSGSGSGTDFTLTISRLEPEDFAVYYCQHYHSSPWTFGQGTKVEIK

SEQ ID NO: 27041 - DNA, 321 bp, Artificial Sequence
  Description of Artificial Sequence: Synthetic polynucleotide
gacatccagatgacccagtctccatcctccccgtctgcatctgttggagacagagtcaccatcacttgccgggcaagtcacaacattaacagctatttaaattggtatcagcagaaatcagggaaagcccctaaactccttatctatgctgcatccagtttgcaaagtggggtcccgtcaaggttcagtggcagtggatctgggacagatttcactctcactttcagtagtctacaacctgaagattttgcaacttactactgtcaacagagttacagtttcccgctcactttcggcggagggaccaaggtggagatgagg

SEQ ID NO: 27042 - protein, 107 aa, Artificial Sequence
  Description of Artificial Sequence: Synthetic polypeptide
DIQMTQSPSSPSASVGDRVTITCRASHNINSYLNWYQQKSGKAPKLLIYAASSLQSGVPSRFSGSGSGTDFTLTFSSLQPEDFATYYCQQSYSFPLTFGGGTKVEMR

SEQ ID NO: 27043 - DNA, 321 bp, Artificial Sequence; identical to SEQ ID NO: 24295
  Description of Artificial Sequence: Synthetic polynucleotide

SEQ ID NO: 27044 - protein, 107 aa, Artificial Sequence; identical to SEQ ID NO: 24296
  Description of Artificial Sequence: Synthetic polypeptide

SEQ ID NO: 27045 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagacatgatttaggctggtatcaacagaaaccagggaaagcccctaagcgcctgatctatgctgcatccagtttgcaaagtggggtcccatcagggttcagcggcagtggatctgggacagaattcactctcacaatcagcagcctgcagcctgaagattttgcaacttattactgtctacaccattatagttaccctcggacgttcggccaagggaccaaggtggaaatcaaa

SEQ ID NO: 27046 - protein, 107 aa, Artificial Sequence
  Description of Artificial Sequence: Synthetic polypeptide
DIQMTQSPSSLSASVGDRVTITCRASQGIRHDLGWYQQKPGKAPKRLIYAASSLQSGVPSGFSGSGSGTEFTLTISSLQPEDFATYYCLHHYSYPRTFGQGTKVEIK

SEQ ID NO: 27047 - DNA, 321 bp, Artificial Sequence
  Description of Artificial Sequence: Synthetic polynucleotide
gacatccagatgacccagtctccatcctccctgtctgcatctgtaggagacagagtcaccatcactttccggacaagtcagggcattagaaatgatttaggctggtatcagcagcaaccagggaaaacccctaagcgcatgatttatgctgcatccagtttgtttagtggggtcccatcaaggttcagcggcagtagatctgggacagatttcactctcacaatcagcagcctgcagcctgaagattttgcaacttattactgtctacagtataatagttaccctcccaccttcggccaagggacacgactggagattaaa

SEQ ID NO: 27048 - protein, 107 aa, Artificial Sequence
  Description of Artificial Sequence: Synthetic polypeptide
DIQMTQSPSSLSASVGDRVTITFRTSQGIRNDLGWYQQQPGKTPKRMIYAASSLFSGVPSRFSGSRSGTDFTLTISSLQPEDFATYYCLQYNSYPPTFGQGTRLEIK

SEQ ID NO: 27049 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttaaaagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattcctgtcagcagtattataactggctgtgcagttttggccaggggaccaagctggagatcaaa

SEQ ID NO: 27050 - protein, 107 aa, Artificial Sequence
  Description of Artificial Sequence: Synthetic polypeptide
EIVMTQSPATLSVSPGERATLSCRASQSVKSNLAWYQQKPGQAPRLLIYGASTRATGIPARFSGSGSGTEFTLTISSLQSEDFAVYSCQQYYNWLCSFGQGTKLEIK

SEQ ID NO: 27051 - DNA, 321 bp, Artificial Sequence; identical to SEQ ID NO: 26961
  Description of Artificial Sequence: Synthetic polynucleotide

SEQ ID NO: 27052 - protein, 107 aa, Artificial Sequence; identical to SEQ ID NO: 26962
  Description of Artificial Sequence: Synthetic polypeptide

SEQ ID NO: 27053 - DNA, 321 bp, Artificial Sequence
  Description of Artificial Sequence: Synthetic polynucleotide
gacatccagatgacccagtctccatcttccgtgtctgcttctgtaggagacagagtcaccatcacttgtcgggcgagtcagggtattagcatctggttagcctggtatcagcagaaaccagggaaagcccctaacctcctgatctatgctgcatccagtttgcaaagtggagtcccatcaaggttcagcggcagaggatctgggacagatttcactctcaccatcagcagcctgcagcctgaagattttgcaacttactattgtcaacaggctaaaagtttcccattcactttcggccctgggaccaaagtggatatcaaa

SEQ ID NO: 27054 - protein, 107 aa, Artificial Sequence
  Description of Artificial Sequence: Synthetic polypeptide
DIQMTQSPSSVSASVGDRVTITCRASQGISIWLAWYQQKPGKAPNLLIYAASSLQSGVPSRFSGRGSGTDFTLTISSLQPEDFATYYCQQAKSFPFTFGPGTKVDIK

SEQ ID NO: 27055 - DNA, 339 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcattataatggacacaactttttggattggtacctgcagaagccagggcagtctccacagctcctgatctatttggtttctaatcgggcctccggggtccctgacaggttcagtggcagtggatcaggcacagattttacactgaaaatcagcagagtggaggctgaggatgttggggtttattactgcatgcaagctctacaaactcccatgtgcagttttggccaggggaccaagttggagatcaaa

SEQ ID NO: 27056 - protein, 113 aa, Artificial Sequence
  Description of Artificial Sequence: Synthetic polypeptide
DIVMTQSPLSLPVTPGEPASISCRSSQSLLHYNGHNFLDWYLQKPGQSPQLLIYLVSNRASGVPDRFSGSGSGTDFTLKISRVEAEDVGVYYCMQALQTPMCSFGQGTKLEIK

SEQ ID NO: 27057 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaattatttagcctggtttcagcagaaaccagggaaagcccctaggtccctgatctatgatgcatccagtttggaaagtggggtcccatcaaagttcagcggcagtaggtctgggacagatttcactctcaccatcggcagcctgcagcctgaagattttgcaacttattactgccaacactatatgacttacccgctcactttcggcgcagggaccaaggtggagatcaaa

SEQ ID NO: 27058 - protein, 107 aa, Artificial Sequence
  Description of Artificial Sequence: Synthetic polypeptide
DIQMTQSPSSLSASVGDRVTITCRASQGIGNYLAWFQQKPGKAPRSLIYDASSLESGVPSKFSGSRSGTDFTLTIGSLQPEDFATYYCQHYMTYPLTFGAGTKVEIK

SEQ ID NO: 27059 - DNA, 321 bp, Artificial Sequence
  Description of Artificial Sequence: Synthetic polynucleotide
gacatccggatgacccagtctccatcctcactgtctgcatctgtaggagacagagtcaccatcacttgtcgggcgagtcaggccattgggaaacatttagcctggtttcagcagaggcctgggaaagcccctaagtccctgatctatgctgcatccagattgcaaagtggggtcccatcaaagttcagcggcagtggatctgggacagatttcactctcaccatcagcagcctgcagcctgaagatcttgcaacttattactgtcaacagtatagtaattatccgctcactttcggcggagggaccaaggtggagatcaaa

SEQ ID NO: 27060 - protein, 107 aa, Artificial Sequence
  Description of Artificial Sequence: Synthetic polypeptide
DIRMTQSPSSLSASVGDRVTITCRASQAIGKHLAWFQQRPGKAPKSLIYAASRLQSGVPSKFSGSGSGTDFTLTISSLQPEDLATYYCQQYSNYPLTFGGGTKVEIK

SEQ ID NO: 27061 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgttagctcaccgctcactttcggcggagggaccaaggtggagatcaaa

SEQ ID NO: 27062 - protein, 108 aa, Artificial Sequence
  Description of Artificial Sequence: Synthetic polypeptide
EIVLTQSPGTLSLSPGERATLSCRASQSVSSSFLAWYQQKPGQAPRLLIYGASSRATGIPDRFSGSGSGTDFTLTISRLEPEDFAVYYCQQYVSSPLTFGGGTKVEIK

SEQ ID NO: 27063 - DNA, 321 bp, Artificial Sequence
  Description of Artificial Sequence: Synthetic polynucleotide
gacatccagatgacccagtctccatcctcactgtctgcatctgtaggagacagcgtcaccatcacttgtcgggcgagtcagggcattggcaagtatttagcctggtttcagcagaaaccagggaaagcccctaagtccctgatctatgctgcatccagtttgctaagtggggtcccatcaaagttcagcggcagtggatctgggacagatttcactctcaccatcagcagccttcagcctgaagattttgccacttattactgccaaaagtatgatacttacccattcactttcggccctgggaccaaagtggatatcaaa

SEQ ID NO: 27064 - protein, 107 aa, Artificial Sequence
  Description of Artificial Sequence: Synthetic polypeptide
DIQMTQSPSSLSASVGDSVTITCRASQGIGKYLAWFQQKPGKAPKSLIYAASSLLSGVPSKFSGSGSGTDFTLTISSLQPEDFATYYCQKYDTYPFTFGPGTKVDIK

SEQ ID NO: 27065 - DNA, 321 bp, Artificial Sequence
  Description of Artificial Sequence: Synthetic polynucleotide
gacatcgagatgacccagtctccaccctcactgtctgcatttgtaggagacagagtcaccatcacttgtcgggcgagtcagggcattagcagatatttagcctgggttcagcagaaaccagggaaagcccctaagtccctgatctatgctgcatccagtttgcaaagtggggtctcatcaaggttcagcggcagtggatctgggacagatttcactctcaccatcagcagcctgcagcctgaagatttcgcaacttattactgcctacggtatgatacttaccctctcattttcggcggagggaccaaggtggagatcaag

SEQ ID NO: 27066 - protein, 107 aa, Artificial Sequence
  Description of Artificial Sequence: Synthetic polypeptide
DIEMTQSPPSLSAFVGDRVTITCRASQGISRYLAWVQQKPGKAPKSLIYAASSLQSGVSSRFSGSGSGTDFTLTISSLQPEDFATYYCLRYDTYPLIFGGGTKVEIK

SEQ ID NO: 27067 - DNA, 339 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctccatagtaatggatacaactatttggattggtacctgctgaagccagggcagtctccacagctcctgatctatttgggttctaatcgggcctccggggtccctgacaggttcagtggcagtggatcaggcacagattttacactgaaaatcagcagaatggaggctgaggatgttgggatttattactgcatgcaagctctactaactcccgtgtgcagttttggccaggggaccaagctggagatcaaa

SEQ ID NO: 27068 - protein, 113 aa, Artificial Sequence
  Description of Artificial Sequence: Synthetic polypeptide
DIVMTQSPLSLPVTPGEPASISCRSSQSLLHSNGYNYLDWYLLKPGQSPQLLIYLGSNRASGVPDRFSGSGSGTDFTLKISRMEAEDVGIYYCMQALLTPVCSFGQGTKLEIK

SEQ ID NO: 27069 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaatcatttagcctggtttcagcagaaaccagggcaagcccctaagtccctgatctatgctgcatccagtttgcaaagtggggtcccatcaaagttcagcggcagtagatctgggacagatttcactctcaccatcagcagcctgcagcctgaagattttgcaacttattactgccaacagtatgttacctaccctctcactttcggcggagggaccaaggtggagatcaaa

SEQ ID NO: 27070 - protein, 107 aa, Artificial Sequence
  Description of Artificial Sequence: Synthetic polypeptide
DIQMTQSPSSLSASVGDRVTITCRASQGISNHLAWFQQKPGQAPKSLIYAASSLQSGVPSKFSGSRSGTDFTLTISSLQPEDFATYYCQQYVTYPLTFGGGTKVEIK

SEQ ID NO: 27071 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaatcatttagcctggtttcagcagaaaccagggaaagcccctaagtccctgatccatgctgcatccagtttgcaaagtggggtcccatcaaaattcagcggcaatagatctgggacagatttcactctcaccatcaacaacctgcagcctgaagattttgtaacttattactgccagcagtatagtaattaccctctcactttcggcggagggaccaaggtggagatcaaa

SEQ ID NO: 27072 - protein, 107 aa, Artificial Sequence
  Description of Artificial Sequence: Synthetic polypeptide
DIQMTQSPSSLSASVGDRVTITCRASQGISNHLAWFQQKPGKAPKSLIHAASSLQSGVPSKFSGNRSGTDFTLTINNLQPEDFVTYYCQQYSNYPLTFGGGTKVEIK

SEQ ID NO: 27073 - DNA, 321 bp, Artificial Sequence
  Description of Artificial Sequence: Synthetic polynucleotide
gacatcgagatgacccagtctccatcctcactgtctgcatctgtaggagacagagtcaccatcacttgtcgggcgagtcagggcattagcagttatttagcctggcttcagcagaaaccagggaaagcccctaagtccctgatctatgctgcatccagtttgcaaagtggggtcccatcaaggttcagcggcagtggatctgggacagatttcactctcaccatcagcagcctgcagcctgaagatttcgcaacttattattgcctacggtatgatacttaccctctcactttcggcggagggaccaaggtggagatcaag

SEQ ID NO: 27074 - protein, 107 aa, Artificial Sequence
  Description of Artificial Sequence: Synthetic polypeptide
DIEMTQSPSSLSASVGDRVTITCRASQGISSYLAWLQQKPGKAPKSLIYAASSLQSGVPSRFSGSGSGTDFTLTISSLQPEDFATYYCLRYDTYPLTFGGGTKVEIK

SEQ ID NO: 27075 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttgccagcagcttagcctggtaccagcagaagcctggccaggctcccaggctcctcatccatggtacatccaccagggccactgatgtcccagccaggttcagtggctttgggtctgggtcggacttcactctcaccatcagcagcctgcagtctgaagattttgcagtttattcctgtcagcagtataatgactggccgtgcagttttggccaggggaccaagctggagatcaaa

SEQ ID NO: 27076 - protein, 107 aa, Artificial Sequence
  Description of Artificial Sequence: Synthetic polypeptide
EIVMTQSPATLSVSPGERATLSCRASQSVASSLAWYQQKPGQAPRLLIHGTSTRATDVPARFSGFGSGSDFTLTISSLQSEDFAVYSCQQYNDWPCSFGQGTKLEIK

SEQ ID NO: 27077 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagactggtttcagcagaaaccagggaaagcccctaagtccctgatctattctgcatccaatttgcaaagtggggtcccatcaaagttcagcggcagtagatctgggacagatttcactctcaccatcagcagcctgcagcctgaagattttgcaacttattactgccaacactatagtaattacccgctcactttcggcggagggaccaaggtggagatcaaa

SEQ ID NO: 27078 - protein, 107 aa, Artificial Sequence
  Description of Artificial Sequence: Synthetic polypeptide
DIQMTQSPSSLSASVGDRVTITCRASQGISNYLDWFQQKPGKAPKSLIYSASNLQSGVPSKFSGSRSGTDFTLTISSLQPEDFATYYCQHYSNYPLTFGGGTKVEIK

SEQ ID NO: 27079 - DNA, 321 bp, Artificial Sequence
  Description of Artificial Sequence: Synthetic polynucleotide
gacatccagatgacccagtctccatcttccctgcctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcattctcacaatcagcagcctgcagcctgaagattttgcaacttattactgtctactgcattatagttaccctcggacgttcggccaagggaccaaggtggaaatcaaa

SEQ ID NO: 27080 - protein, 107 aa, Artificial Sequence
  Description of Artificial Sequence: Synthetic polypeptide
DIQMTQSPSSLPASVGDRVTITCRASQGIRNDLGWYQQKPGKAPKRLIYAASSLQSGVPSRFSGSGSGTEFILTISSLQPEDFATYYCLLHYSYPRTFGQGTKVEIK

SEQ ID NO: 27081 - DNA, 321 bp, Artificial Sequence
  Description of Artificial Sequence: Synthetic polynucleotide
gacatccggatgacccagtctccatcctcactgtctgcatctgtaggagacagagtcaccatcacttgtcgggcgagtcaggccattgggaaacatttagcctggtttcagcagaggcctgggaaagcccctaagtccctgatctatgctgcatccagattgcaaagtggggtcccatcaaagttcagcggcagtggatctgggacagatttcactctcaccatcagcagcctgcagcctgaagatcttgcaacttattactgtcaacactatagtaattatccgctcacttttgtcggagggaccaaggtggagatcaca

SEQ ID NO: 27082 - protein, 107 aa, Artificial Sequence
  Description of Artificial Sequence: Synthetic polypeptide
DIRMTQSPSSLSASVGDRVTITCRASQAIGKHLAWFQQRPGKAPKSLIYAASRLQSGVPSKFSGSGSGTDFTLTISSLQPEDLATYYCQHYSNYPLTFVGGTKVEIT

SEQ ID NO: 27083 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaatcatttagcctggtttcagcagaaaccagggaaagcccctaagtccctgatccatgctgcatccagtttgcaaagtggggtcccatcaaaattcagcggcaatagatctgggacagatttcactctcaccatcaacaacctgcagcctgaagattttgtaacttattactgccaccagtatagtaattaccctctcactttcggcggagggaccaaggtggagatcaaa

SEQ ID NO: 27084 - protein, 107 aa, Artificial Sequence
  Description of Artificial Sequence: Synthetic polypeptide
DIQMTQSPSSLSASVGDRVTITCRASQGISNHLAWFQQKPGKAPKSLIHAASSLQSGVPSKFSGNRSGTDFTLTINNLQPEDFVTYYCHQYSNYPLTFGGGTKVEIK

SEQ ID NO: 27085 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattggcaagtatttagcctggtttcagcagaaaccagggaaagcccctaagtccctgatctctgctgcatccagtgtgctaagtggggtcccatcaaagttcagcggcagtggatctgggacagatttcactctcaccatcagcagccttcagcctgaagattttgccacttattactgccaaaagtatgatacttacccattcactttcggccctgggaccaaagtggatatcaaa

SEQ ID NO: 27086 - protein, 107 aa, Artificial Sequence
  Description of Artificial Sequence: Synthetic polypeptide
DIQMTQSPSSLSASVGDRVTITCRASQGIGKYLAWFQQKPGKAPKSLISAASSVLSGVPSKFSGSGSGTDFTLTISSLQPEDFATYYCQKYDTYPFTFGPGTKVDIK

SEQ ID NO: 27087 - DNA, 321 bp, Artificial Sequence
  Description of Artificial Sequence: Synthetic polynucleotide
gacatccatatgacccagtctccatcctcactgtctgcatctgtaggagacagagtcaccatcacttgtcgggcgagtcaggccattaggaattatttagcctggtgtcagcagaaaccagggaaagcccctaagaccctgatctatgctgcatccagtttgcaaagtggggtcccatcaaagttcagcggcagtggatctgggacagatttcactctcaccatcagcagcctgcagcctgaagattttgcaacttattactgccaacagtatagtaattaccctctcactttcggcggagggaccaaggtggagatcaaa

SEQ ID NO: 27088 - protein, 107 aa, Artificial Sequence
  Description of Artificial Sequence: Synthetic polypeptide
DIHMTQSPSSLSASVGDRVTITCRASQAIRNYLAWCQQKPGKAPKTLIYAASSLQSGVPSKFSGSGSGTDFTLTISSLQPEDFATYYCQQYSNYPLTFGGGTKVEIK

SEQ ID NO: 27089 - DNA, 321 bp, Artificial Sequence
  Description of Artificial Sequence: Synthetic polynucleotide
gacatccggatgacccagtctccatcctcactgtctgcatctgtaggagacagagtcaccatcacttgtcgggcgagtcaggccattgggaaacatttagcctggtttcagcagaggcctgggaaagcccctaagtccctgatctatgctgcatccagattgcaaagtggggtcccatcaaagttcagcggcagtggatctgggacagatttcactctcaccatcagcagcctgcagcctgaagatcttgcaacttattactgtcaacactatagtaattatccgctcactttcggcggagggaccaaggtggagatcaaa

SEQ ID NO: 27090 - protein, 107 aa, Artificial Sequence
  Description of Artificial Sequence: Synthetic polypeptide
DIRMTQSPSSLSASVGDRVTITCRASQAIGKHLAWFQQRPGKAPKSLIYAASRLQSGVPSKFSGSGSGTDFTLTISSLQPEDLATYYCQHYSNYPLTFGGGTKVEIK

SEQ ID NO: 27091 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaatcatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtatagtaattaccctctcactttcggcggagggaccaaggtggagatcaaa

SEQ ID NO: 27092 - protein, 107 aa, Artificial Sequence
  Description of Artificial Sequence: Synthetic polypeptide
DIQMTQSPSSLSASVGDRVTITCRASQGISNHLAWFQQKPGKAPKSLIYAASSLQSGVPSKFSGSGSGTDFTLTISSLQPEDFATYYCQQYSNYPLTFGGGTKVEIK

SEQ ID NO: 27093 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatgttttagacatctccaacaataagaattccttaggttggttccagcagaaaccaggtcagcctcccaagctgctcattaactgggcatctacccgggaatccggggtccctgaccgcttcagtggcagcgggtctgggacagatttcactctcaccatcagcagcctgcagactgaagatgtggcagtttatcactgtcagcaatattataacattcctccgacgttcggccgagggaccaaggtggaaatcaaa

SEQ ID NO: 27094 - protein, 113 aa, Artificial Sequence
  Description of Artificial Sequence: Synthetic polypeptide
DIVMTQSPDSLAVSLGERATINCKSSQNVLDISNNKNSLGWFQQKPGQPPKLLINWASTRESGVPDRFSGSGSGTDFTLTISSLQTEDVAVYHCQQYYNIPPTFGRGTKVEIK

SEQ ID NO: 27095 - DNA, 339 bp, Artificial Sequence
  Description of Artificial Sequence: Synthetic polynucleotide
gacatcgtgatgacccagtctccagactccctggctgtgtctctgggcgagagggccaccatcacctgcaagtccagccagaatgttttaaagacctccaacaataggaactacttagcttggtaccagcagaaaccaggacagcctcctaaggtgctcatttactgggcatctacccgggaatccggggtccctgaccgattcagtggcagcgggtctgggacagatttcactctcatcatcagcagcctgcaggctgaagatgtggcagtttattactgtcaccaatattatagtattccgtggaccttcggccaagggaccaaggtggaaatcaag

SEQ ID NO: 27096 - protein, 113 aa, Artificial Sequence
  Description of Artificial Sequence: Synthetic polypeptide
DIVMTQSPDSLAVSLGERATITCKSSQNVLKTSNNRNYLAWYQQKPGQPPKVLIYWASTRESGVPDRFSGSGSGTDFTLIISSLQAEDVAVYYCHQYYSIPWTFGQGTKVEIK

SEQ ID NO: 27097 - DNA, 321 bp, Artificial Sequence
  Description of Artificial Sequence: Synthetic polynucleotide
gacatccagatgacccagtctccatcctcactgtctgcatctgttggagacagagtcaccataacttgtcgggcgagtcagggcattggcaattatttagcctggtttcagcagaaaccaggtaaagtccctaagtccctgatctatgctgcatccagtttgcaaagtggggtcccatcaaagttcagcggcagtggatctgggacagatttcactctcaccatcagcagcctgcagcctgaagattttacaacttattactgccaacaatatatgacttacccaatcactttcggccctgggaccaaagtggatatcaaa

SEQ ID NO: 27098 - protein, 107 aa, Artificial Sequence
  Description of Artificial Sequence: Synthetic polypeptide
DIQMTQSPSSLSASVGDRVTITCRASQGIGNYLAWFQQKPGKVPKSLIYAASSLQSGVPSKFSGSGSGTDFTLTISSLQPEDFTTYYCQQYMTYPITFGPGTKVDIK

SEQ ID NO: 27099 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtatcttacttacccattcactttcggccctgggaccaaagtggatatcaaa

SEQ ID NO: 27100 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYLTYPFTFGPGTKVDIK

SEQ ID NO: 27101 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagcattggtgttagcttacactggtaccagcagaaaccagatcagtctccacaactcctcatcaagtatgcttcccagtccttctcaggggtcccctcgaggttcagtggcagtggatctgggacagatttcaccctcaccatcaatagcctggaagctgaagatgctgcaacgtattactgtcatcagagtcgtagtttaccattcactttcggccctgggtccaaagtggatatcaaa

SEQ ID NO: 27102 - protein, 107 aa, Artificial Sequence
  Description of Artificial Sequence: Synthetic polypeptide
EIVLTQSPDFQSVTPKEKVTITCRASQSIGVSLHWYQQKPDQSPQLLIKYASQSFSGVPSRFSGSGSGTDFTLTINSLEAEDAATYYCHQSRSLPFTFGPGSKVDIK

SEQ ID NO: 27103 - DNA, 321 bp, Artificial Sequence; identical to SEQ ID NO: 27091
  Description of Artificial Sequence: Synthetic polynucleotide

SEQ ID NO: 27104 - protein, 107 aa, Artificial Sequence; identical to SEQ ID NO: 27092
  Description of Artificial Sequence: Synthetic polypeptide

SEQ ID NO: 27105 - DNA, 321 bp, Artificial Sequence; identical to SEQ ID NO: 25705
  Description of Artificial Sequence: Synthetic polynucleotide

SEQ ID NO: 27106 - protein, 107 aa, Artificial Sequence; identical to SEQ ID NO: 24168
  Description of Artificial Sequence: Synthetic polypeptide

SEQ ID NO: 27107 - DNA, 321 bp, Artificial Sequence
  Description of Artificial Sequence: Synthetic polynucleotide
gacatccagatgaccctgtgtccatcttccccgcctgcatctgttggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcattctcacaatcagcagcctgcagcctgaagattttgcaacttattactgtctactgcataatagttaccctcggacgttcggccaagggaccaaggtggaaatcaaa

SEQ ID NO: 27108 - protein, 107 aa, Artificial Sequence
  Description of Artificial Sequence: Synthetic polypeptide
DIQMTLCPSSPPASVGDRVTITCRASQGIRNDLGWYQQKPGKAPKRLIYAASSLQSGVPSRFSGSGSGTEFILTISSLQPEDFATYYCLLHNSYPRTFGQGTKVEIK

SEQ ID NO: 27109 - DNA, 321 bp, Artificial Sequence
  Description of Artificial Sequence: Synthetic polynucleotide
gacatccagatgacccagtctccatcttccccgcctgcatctgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcattctcacaatcagcagcctgcagcctgaagattttgcaacttattactgtgtaatgcattatagttaccctcggacgttcggccaagggaccaaggtggaaatcaaa

SEQ ID NO: 27110 - protein, 107 aa, Artificial Sequence
  Description of Artificial Sequence: Synthetic polypeptide
DIQMTQSPSSPPASVGDRVTITCRASQGIRNDLGWYQQKPGKAPKRLIYAASSLQSGVPSRFSGSGSGTEFILTISSLQPEDFATYYCVMHYSYPRTFGQGTKVEIK

SEQ ID NO: 27111 - DNA, 321 bp, Artificial Sequence
  Description of Artificial Sequence: Synthetic polynucleotide
gacatccagatgacccagtctccatcctccccgcctgcatctgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcactctcacaatcagcagcctgcagcctgaagattttgcaacttattactgtgtaatgcataatagttaccctcggacgttcggccaagggaccaaggtggaaatcaaa

SEQ ID NO: 27112 - protein, 107 aa, Artificial Sequence
  Description of Artificial Sequence: Synthetic polypeptide
DIQMTQSPSSPPASVGDRVTITCRASQGIRNDLGWYQQKPGKAPKRLIYAASSLQSGVPSRFSGSGSGTEFTLTISSLQPEDFATYYCVMHNSYPRTFGQGTKVEIK

SEQ ID NO: 27113 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaatcatttagcctggtttcagcagaaaccagggaaagcccctaagtccctgatccatgctgcatccagtttgcaaagtggggtcccatcaaaattcagcggcaatagatctgggacagatttcactctcaccatcaacaacctgcagcctgaagattttgtaacttattactgccagcagtatattaattaccctctcactttcggcggagggaccaaggtggagatcaaa

SEQ ID NO: 27114 - protein, 107 aa, Artificial Sequence
  Description of Artificial Sequence: Synthetic polypeptide
DIQMTQSPSSLSASVGDRVTITCRASQGISNHLAWFQQKPGKAPKSLIHAASSLQSGVPSKFSGNRSGTDFTLTINNLQPEDFVTYYCQQYINYPLTFGGGTKVEIK

SEQ ID NO: 27115 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaatcatttagcctggtttcagcagaaaccagggaaagcccctaagtccctgatctatgctgcatccagtttgcatagtggggtcccatcaaagttcagcggcagtagatctgggacagatttcactctcaccatcagcagcctgcagcctgaagattttgcaacttattactgccaacagtatgttacttaccctctcactttcggcggagggaccaaggtggagatcaaa

SEQ ID NO: 27116 - protein, 107 aa, Artificial Sequence
  Description of Artificial Sequence: Synthetic polypeptide
DIQMTQSPSSLSASVGDRVTITCRASQGISNHLAWFQQKPGKAPKSLIYAASSLHSGVPSKFSGSRSGTDFTLTISSLQPEDFATYYCQQYVTYPLTFGGGTKVEIK

SEQ ID NO: 27117 - DNA, 321 bp, Artificial Sequence
  Description of Artificial Sequence: Synthetic polynucleotide
gaaattgtgctgactcagtctccagactttcagtctgtgactccaaaggagaaagtcaccatcacctgccgggccagtcagagcatcggtgttagcttacactggtaccagcagaaaccagatcagtctccacagctcctcatcaagtatgcttcccagtccctctcaggggtcccctcgaggttcagtggcagtggatctgggacagatttcaccctcaccatcaatagcctggaagctgaagatgctgcaacgtattactgtcatcagagtcgcagtttaccattcactttcggccctgggtccaaagtggatatcaaa

SEQ ID NO: 27118 - protein, 107 aa, Artificial Sequence
  Description of Artificial Sequence: Synthetic polypeptide
EIVLTQSPDFQSVTPKEKVTITCRASQSIGVSLHWYQQKPDQSPQLLIKYASQSLSGVPSRFSGSGSGTDFTLTINSLEAEDAATYYCHQSRSLPFTFGPGSKVDIK

SEQ ID NO: 27119 - DNA, 324 bp, Artificial Sequence
  Description of Artificial Sequence: Synthetic polynucleotide
gaaattgtgttgacgcagtctccaggcaccctgtctttgtctccaggggaaagagtcaccctctcctgcagggccagtcagaggattaccaccaacttcttagcttggtaccagcagaaacctggccaggctcccaggctcctcatctatggtgcatccagcagggccactggcatcccagacaggttcagtggcagtgggtctgggacagacttcactctcaccatcagcagactggagtctgaagattttgcagtttattactgtcagcagtatgttagttcattgctcactttcggcggagggaccaaggtggagatcaaa

SEQ ID NO: 27120 - protein, 108 aa, Artificial Sequence
  Description of Artificial Sequence: Synthetic polypeptide
EIVLTQSPGTLSLSPGERVTLSCRASQRITTNFLAWYQQKPGQAPRLLIYGASSRATGIPDRFSGSGSGTDFTLTISRLESEDFAVYYCQQYVSSLLTFGGGTKVEIK

SEQ ID NO: 27121 - DNA, 321 bp, Artificial Sequence
  Description of Artificial Sequence: Synthetic polynucleotide
gacatccagatgacccagtgtccatcttccccgcctgcatctgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcattctcacaatcagcagcgtgcagcgtgaagattttgcaacttattactgtgtaatgcattatagttaccctcggacgttcggccaagggaccaaggtggaaatcaaa

SEQ ID NO: 27122 - protein, 107 aa, Artificial Sequence
  Description of Artificial Sequence: Synthetic polypeptide
DIQMTQCPSSPPASVGDRVTITCRASQGIRNDLGWYQQKPGKAPKRLIYAASSLQSGVPSRFSGSGSGTEFILTISSVQREDFATYYCVMHYSYPRTFGQGTKVEIK

SEQ ID NO: 27123 - DNA, 321 bp, Artificial Sequence
  Description of Artificial Sequence: Synthetic polynucleotide
gacatccagatgacccagtctccatcctcactgtctgcatctgtaggagacagaatcaccatcacttgtcggacgagtcaggacattggcaattatttagcctggtttcagcagaaaccagggaaagcccctaagtccctgatctatgctgcatccagtttacagagtggggtcccatcaaagttcagcggcagtagatctgggacagatttcactctcaccatcagcagcctgcagtctgaagattttgcaacttattactgccaacagtatgttacttacccgctcactttcggcggagggaccaaggtggagatcaaa

SEQ ID NO: 27124 - protein, 107 aa, Artificial Sequence
  Description of Artificial Sequence: Synthetic polypeptide
DIQMTQSPSSLSASVGDRITITCRTSQDIGNYLAWFQQKPGKAPKSLIYAASSLQSGVPSKFSGSRSGTDFTLTISSLQSEDFATYYCQQYVTYPLTFGGGTKVEIK

SEQ ID NO: 27125 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcagcttcttagcttggtaccagcagaaacctggccaggctcccaggctcctcatgtatggtgcatccagcagggccattggcatcccagacaggttcagtggcagtgggtctgggacagacttcactctcaccatcagcagactggagcctgaagattttgcagtgtattactgtcagcagtatgttagctcaccgctcactttcggcggagggaccaaggtggagatcaaa

SEQ ID NO: 27126 - protein, 108 aa, Artificial Sequence
  Description of Artificial Sequence: Synthetic polypeptide
EIVLTQSPGTLSLSPGERATLSCRASQSVSSSFLAWYQQKPGQAPRLLMYGASSRAIGIPDRFSGSGSGTDFTLTISRLEPEDFAVYYCQQYVSSPLTFGGGTKVEIK

SEQ ID NO: 27127 - DNA, 321 bp, Artificial Sequence
  Description of Artificial Sequence: Synthetic polynucleotide
gaaatagtgatgacggagtctccagccaccctgtctgtgtctccaggggaaagagccaccctctcctgcagggccagtcagagtgttaacaacaacttagcctggtaccggcagaaacctggccaggctcccaggctcctcatctatggtgcatccaccagggccactggtatcccacccaggttcagtggcagtgggtctgggacagagttcactctctccatcagcagcctgcagtctgaagattttgcagtttattactgtcagcagtataatgactggccgtgcagttttggccaggggaccaaactggagatcaga

SEQ ID NO: 27128 - protein, 107 aa, Artificial Sequence
  Description of Artificial Sequence: Synthetic polypeptide
EIVMTESPATLSVSPGERATLSCRASQSVNNNLAWYRQKPGQAPRLLIYGASTRATGIPPRFSGSGSGTEFTLSISSLQSEDFAVYYCQQYNDWPCSFGQGTKLEIR

SEQ ID NO: 27129 - DNA, 324 bp, Artificial Sequence
  Description of Artificial Sequence: Synthetic polynucleotide
gaagttgtgttgacgcagtctccaggcaccctgtctttgtctccaggggaaagagccaccctctcctgcagggccagtcagagtgttagcagcagcttcttagcctggtaccagcagaaacctggccaggctcccaggctcctcatctatggtacatccaccagggccactggcatccctgacaggttcagtggcagtgggtctgggacagacttcattctcaccatcagcagactggagcctgaagattttgcagtatattactgtcaacagtatgataggtcaccattcactttcggccctgggaccaaagtggatatcaaa

SEQ ID NO: 27130 - protein, 108 aa, Artificial Sequence
  Description of Artificial Sequence: Synthetic polypeptide
EVVLTQSPGTLSLSPGERATLSCRASQSVSSSFLAWYQQKPGQAPRLLIYGTSTRATGIPDRFSGSGSGTDFILTISRLEPEDFAVYYCQQYDRSPFTFGPGTKVDIK

SEQ ID NO: 27131 - DNA, 321 bp, Artificial Sequence
  Description of Artificial Sequence: Synthetic polynucleotide
gacatccagatgacccagtctccatcttccctgcctgcatctgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcattctcacaatcagcagcctgcagcctgaagattttgcaacttattactgtctaatgcattatagttaccctcggacgttcggccaagggaccaaggtggaaatcaaa

SEQ ID NO: 27132 - protein, 107 aa, Artificial Sequence
  Description of Artificial Sequence: Synthetic polypeptide
DIQMTQSPSSLPASVGDRVTITCRASQGIRNDLGWYQQKPGKAPKRLIYAASSLQSGVPSRFSGSGSGTEFILTISSLQPEDFATYYCLMHYSYPRTFGQGTKVEIK

SEQ ID NO: 27133 - DNA, 321 bp, Artificial Sequence
  Description of Artificial Sequence: Synthetic polynucleotide
gacatccagatgaccctgtctccatcttccctgcctgcatctgtaggagacagagtcaccatcacttgccgggcaagtcagggcattagaaatgatttaggctggtatcagcagaaaccagggaaagcccctaagcgccttatctatggtgcatccagtttgcaaagtggggtcccatcaaggttcagcggcagtggatctgggacagaattcattctcacaatcagcagcctgcagcctgaagattttgcaacttattactgtgtaatgcataatagttaccctcggacgttcggccaagggaccaaggtggaaatcaaa

SEQ ID NO: 27134 - protein, 107 aa, Artificial Sequence
  Description of Artificial Sequence: Synthetic polypeptide
DIQMTLSPSSLPASVGDRVTITCRASQGIRNDLGWYQQKPGKAPKRLIYGASSLQSGVPSRFSGSGSGTEFILTISSLQPEDFATYYCVMHNSYPRTFGQGTKVEIK

SEQ ID NO: 27135 - DNA, 321 bp, Artificial Sequence
  Description of Artificial Sequence: Synthetic polynucleotide
gaaattgtgctgactcagtctccagactttaagtctgtgactccaaaggagaaagtcaccatcacctgccgggccagtcagagcattggtagtagcttacactggtaccagcagaaaccagatcagtctccaaagctcctcgtcaagtatgcttcccagtccttctcaggggtcccctcgaggttcagtggcagtggatctgggacagatttcaccctcaccatcaacagcctggaggctgaagatggtgcaacgtattactgtcatcagagtagaagtttaccgtggacgttcggccaagggaccaaggtggaaatcaaa

SEQ ID NO: 27136 - protein, 107 aa, Artificial Sequence
  Description of Artificial Sequence: Synthetic polypeptide
EIVLTQSPDFKSVTPKEKVTITCRASQSIGSSLHWYQQKPDQSPKLLVKYASQSFSGVPSRFSGSGSGTDFTLTINSLEAEDGATYYCHQSRSLPWTFGQGTKVEIK

SEQ ID NO: 27137 - DNA, 321 bp, Artificial Sequence
  Description of Artificial Sequence: Synthetic polynucleotide
gacatccagatgacccagtgtccatcttccccgcctgcatttgtaggagacagagtcaccatcacttgccgggcaagtcagggcattagaaatgatttaggctggtatcagcagaaaccagggaaagcccctaagcgccttatctgtgctgcatccagtttgcaaagtggggtcccatcaaggttcagcggcagtggatctgggacagaattcattctcacaatcagcagcctgcagcctgaagattttgcaacttattactgtgtaatgcataatagttaccctcggacgttcggccaagggaccaaggtggaaatcaaa

SEQ ID NO: 27138 - protein, 107 aa, Artificial Sequence
  Description of Artificial Sequence: Synthetic polypeptide
DIQMTQCPSSPPAFVGDRVTITCRASQGIRNDLGWYQQKPGKAPKRLICAASSLQSGVPSRFSGSGSGTEFILTISSLQPEDFATYYCVMHNSYPRTFGQGTKVEIK

SEQ ID NO: 27139 - DNA, 321 bp, Artificial Sequence
  Description of Artificial Sequence: Synthetic polynucleotide
gacatcctgatgacccagtctccatcctcactgtctgcatctgtaggagacagagtcaccatcacttgtcgggcgagtcagggcattggcaattatttagcctggtttcagcagagaccagggaaagcccctaagtccctgatctatgctgcatccagtttgcaaagtggggtcccatcaaagttcagcggcactcgatctgggacagatttcactctcaccatcagcagcctgcagcctgacgattttgcaacttattactgccaacagtatgttaattaccctctcactttcggcggagggaccaaggtggagatcaac

SEQ ID NO: 27140 - protein, 107 aa, Artificial Sequence
  Description of Artificial Sequence: Synthetic polypeptide
DILMTQSPSSLSASVGDRVTITCRASQGIGNYLAWFQQRPGKAPKSLIYAASSLQSGVPSKFSGTRSGTDFTLTISSLQPDDFATYYCQQYVNYPLTFGGGTKVEIN

SEQ ID NO: 27141 - DNA, 321 bp, Artificial Sequence
  Description of Artificial Sequence: Synthetic polynucleotide
gacatccggatgacccagtctccatcctcactgtctgcatctgtaggagacagagtcaccatcacttgtcgggcgagtcaggccattgggaaacatttagcctggtttcagcagaggcctgggaaagcccctaagtccctgatctatgctgcatccagattgcaaagtggggtcccatcaaagttcagcggcagtggatctgggacagatttcactctcaccatcagcagcgtgcagcctgaagatcttgcaacttattaccgtcaacacaccagtaaatctccagtgcagcttgtcggaggcaccaaggtggagatcaca

SEQ ID NO: 27142 - protein, 107 aa, Artificial Sequence
  Description of Artificial Sequence: Synthetic polypeptide
DIRMTQSPSSLSASVGDRVTITCRASQAIGKHLAWFQQRPGKAPKSLIYAASRLQSGVPSKFSGSGSGTDFTLTISSVQPEDLATYYRQHTSKSPVQLVGGTKVEIT

SEQ ID NO: 27143 - DNA, 321 bp, Artificial Sequence
  Description of Artificial Sequence: Synthetic polynucleotide
gacatccagatgacccagtctccatcttccccgcctgcatctgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcattctcactatcagcagcctgcagcctgaagattttgcaacttattactgtgtaatgcataatagttaccctcggacgttcggccaagggaccaaggtggaaatcaaa

SEQ ID NO: 27144 - protein, 107 aa, Artificial Sequence
  Description of Artificial Sequence: Synthetic polypeptide
DIQMTQSPSSPPASVGDRVTITCRASQGIRNDLGWYQQKPGKAPKRLIYAASSLQSGVPSRFSGSGSGTEFILTISSLQPEDFATYYCVMHNSYPRTFGQGTKVEIK

SEQ ID NO: 27145 - DNA, 321 bp, Artificial Sequence
  Description of Artificial Sequence: Synthetic polynucleotide
gacatccagatgacccagtctccatcttccccgcctgcatctgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcattctcacaatcagcagcctgcagcctgaagattttgcaacttattactgtctaatgcattatagttaccctcggacgttcggccaagggaccaaggtggaaatcaaa

SEQ ID NO: 27146 - protein, 107 aa, Artificial Sequence
  Description of Artificial Sequence: Synthetic polypeptide
DIQMTQSPSSPPASVGDRVTITCRASQGIRNDLGWYQQKPGKAPKRLIYAASSLQSGVPSRFSGSGSGTEFILTISSLQPEDFATYYCLMHYSYPRTFGQGTKVEIK

SEQ ID NO: 27147 - DNA, 321 bp, Artificial Sequence
  Description of Artificial Sequence: Synthetic polynucleotide
gacatccagatgacccagtgtccatcttccccgcctgcatttgtaggagacagagtcaccatcacttgccgggcaagtcagggcattagaaatgatttaggctggtatcagcagaaaccagggaaagcccctaagcgccttatctatgctgcatccagtttgcaaagtggggtcccatcaaggttcagcggcagtggatctgggacagaattcattctcacaatcagcagcgtgcagcgtgaagattttgcaacttattactgtgtaatgcattatagttaccctcggacgttcggccaagggaccaaggtggaaatcaaa

SEQ ID NO: 27148 - protein, 107 aa, Artificial Sequence
  Description of Artificial Sequence: Synthetic polypeptide
DIQMTQCPSSPPAFVGDRVTITCRASQGIRNDLGWYQQKPGKAPKRLIYAASSLQSGVPSRFSGSGSGTEFILTISSVQREDFATYYCVMHYSYPRTFGQGTKVEIK

SEQ ID NO: 27149 - DNA, 321 bp, Artificial Sequence
  Description of Artificial Sequence: Synthetic polynucleotide
gacatccagatgacccagtctccatcctcacagtctgcatctgtaggagacagagtcaccatcacttgtcgggcgagtcagggcattagcaattatttagactggtttcagcagaaaccagggaaagcccctaagtccctgatctattctgcatccaatttgcaaagtggggtcccatcaaagttcagcggcagtagatctgggacagatttcactctcaccatcagcagcctgcagcctgaagattttgcaacttattactgccaacactatagtaattacccgctcactttcggcggagggaccaaggtggagatcaaa

SEQ ID NO: 27150 - protein, 107 aa, Artificial Sequence
  Description of Artificial Sequence: Synthetic polypeptide
DIQMTQSPSSQSASVGDRVTITCRASQGISNYLDWFQQKPGKAPKSLIYSASNLQSGVPSKFSGSRSGTDFTLTISSLQPEDFATYYCQHYSNYPLTFGGGTKVEIK

SEQ ID NO: 27151 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtattagccgcagccacttagtctggtaccagcagaaacctaaccaggctcccaggctcctcctctatgttacatccagcagggccactggcatcccagacaggtttagtggcagtgggtctgggacagacttcactctcaccatcagaagtctggagcctgaagattttgcaatgtattactgtcagcagtatggtagctcaccgtggacgttcggccaagggaccaaggtggaaatcaaa

SEQ ID NO: 27152 - protein, 108 aa, Artificial Sequence
  Description of Artificial Sequence: Synthetic polypeptide
EIVLTQSPGTLSLSPGERATLSCRASQSISRSHLVWYQQKPNQAPRLLLYVTSSRATGIPDRFSGSGSGTDFTLTIRSLEPEDFAMYYCQQYGSSPWTFGQGTKVEIK

SEQ ID NO: 27153 - DNA, 321 bp, Artificial Sequence
  Description of Artificial Sequence: Synthetic polynucleotide
gacatccagatgaccctgtctccatcttccccgcctgcatttgtaggagacagagtcaccatcactcgccgggcaagtcagggcattagaaatgatttaggctggtatcagcagaaaccagggaaagcccctaagcgccttatatgtggtgcatccagtttgcaaagtggggtcccatcaaggttcagcggcagtggatctgggacagaattcattctcacaatcagcagcctgcagcgtgaagattttgcaacttattactgtgtaatgcataatagttaccctcggacgttcggccaagggaccaaggtggaaatcaaa

SEQ ID NO: 27154 - protein, 107 aa, Artificial Sequence
  Description of Artificial Sequence: Synthetic polypeptide
DIQMTLSPSSPPAFVGDRVTITRRASQGIRNDLGWYQQKPGKAPKRLICGASSLQSGVPSRFSGSGSGTEFILTISSLQREDFATYYCVMHNSYPRTFGQGTKVEIK

SEQ ID NO: 27155 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatactgcatccaatttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 27156 - protein, 107 aa, Artificial Sequence
  Description of Artificial Sequence: Synthetic polypeptide
DIQMTQSPSSVSASVGDRVTITCRASQGISSWLAWYQQKPGKAPKLLIYTASNLQSGVPSRFSGSGSGTDFTLTISSLQPEDFATYYCQQANSFPFTFGPGTKVDIK

SEQ ID NO: 27157 - DNA, 321 bp, Artificial Sequence
  Description of Artificial Sequence: Synthetic polynucleotide
gacatccagatgacccagtctccatcctcactgtctggatctgtaggagacagagtcaccatcacttgtcgggcgagtcagggcattagcaattatttagcctggtttcagcagaaaccagggaaagcccctaaatccctgatctatgctgcatccaatttacaaagtggggtcccatcaaagttcagcggcagtagatctgggacagatttcactctcaccatcagcagcctgcagcctgaagattttgcaacttattactgccaacagtatatgacttacccgctcactttcggcggagggaccagggtggagatcaaa

SEQ ID NO: 27158 - protein, 107 aa, Artificial Sequence
  Description of Artificial Sequence: Synthetic polypeptide
DIQMTQSPSSLSGSVGDRVTITCRASQGISNYLAWFQQKPGKAPKSLIYAASNLQSGVPSKFSGSRSGTDFTLTISSLQPEDFATYYCQQYMTYPLTFGGGTRVEIK

SEQ ID NO: 27159 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatactgcatccaatttgcaaagtggggtcccatcaaggttcagcggcagtggatctgggacagatttcactctcaccatcagcagcctgcagcgtgaagattttgcaacttactattgtcaacaggctaacagtttcccattcactttcggccctgggaccaaagtggatatcaaa

SEQ ID NO: 27160 - protein, 107 aa, Artificial Sequence
  Description of Artificial Sequence: Synthetic polypeptide
DIQMTQSPSSVSASVGDRVTITCRASQGISSWLAWYQQKPGKAPKLLIYTASNLQSGVPSRFSGSGSGTDFTLTISSLQREDFATYYCQQANSFPFTFGPGTKVDIK

SEQ ID NO: 27161 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaagctcttgatctatactgcatccaatttgcaaagtggggtcccatcaaggttcagcggcagtggatctgggacagatttcactctcaccatcagcagcctgcagcctgaagattttgcaacttactattgtcaacaggctaacagtttcccattcactttcggccgtgggaccaaagtggatatcaaa

SEQ ID NO: 27162 - protein, 107 aa, Artificial Sequence
  Description of Artificial Sequence: Synthetic polypeptide
DIQMTQSPSSVSASVGDRVTITCRASQGISSWLAWYQQKPGKAPKLLIYTASNLQSGVPSRFSGSGSGTDFTLTISSLQPEDFATYYCQQANSFPFTFGRGTKVDIK

SEQ ID NO: 27163 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttgaaaagttccaaccataggaactacttagcttggtaccaacagaaaccagggcagcctcctcagcttctcatttactgggcatctacccgggaaaccggggtccctgaccgattcagtggcagcgggtctgggacagatttcactctcaccatcagcagccttcaggctgaagatgtgtcagtttattcctgtcagcaatattcttctattccgtggacgttcggccaagggaccaaggtggaaatcaat

SEQ ID NO: 27164 - protein, 113 aa, Artificial Sequence
  Description of Artificial Sequence: Synthetic polypeptide
DIVMTQSPDSLAVSLGERATINCKSSQSVLKSSNHRNYLAWYQQKPGQPPQLLIYWASTRETGVPDRFSGSGSGTDFTLTISSLQAEDVSVYSCQQYSSIPWTFGQGTKVEIN

SEQ ID NO: 27165 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttggcctggtttcagcagaaaccagggaaagcccctaagtccctgatctacgctgcatccagtttgcaaagtggggtcccatcaaagttcagcggcagtggatctgggacagatttcactctcaccatcagtagcctgcagcctgaagattttgcaacttattactgcctatattatcttaattatccgctcactttcggcggagggaccaaggtggagatcaaa

SEQ ID NO: 27166 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCLYYLNYPLTFGGGTKVEIK

SEQ ID NO: 27167 - DNA, 321 bp, Artificial Sequence
  Description of Artificial Sequence: Synthetic polynucleotide
gacatccagatgacccattctccatcctccctgtctgcatctgtaggagacagagtcaccatcacttgccgggcaagtcagaacattagtaattatgttaattggtatcagcagaaaccagggaaagcccctaagttcctgatctatactgcatcgagtttgcaaagtggggtctcgtcacggttcagtggcagtggatctgggacagatttcactctcaccatcagcagtgtgcaccgtgacgattttgcaatttactattgtcagcagtattactttaccccattcactttcggccgtgggaccaaagtggatatcaaa

SEQ ID NO: 27168 - protein, 107 aa, Artificial Sequence
  Description of Artificial Sequence: Synthetic polypeptide
DIQMTHSPSSLSASVGDRVTITCRASQNISNYVNWYQQKPGKAPKFLIYTASSLQSGVSSRFSGSGSGTDFTLTISSVHRDDFAIYYCQQYYFTPFTFGRGTKVDIK

SEQ ID NO: 27169 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgtttacagcaactacttagcctggtaccagcagaaacctggccaggctcccaggctcctcatctatggtgcatcaagcagggccactggcatcccagacaggttcggtggcagtgggtctgggacagacttcactctcgccataagcagactggagcctgaagactttacaatatattactgtcagcagtatgaagactcaccgtggacgttcggccaagggaccaaggtggaaatcaaa

SEQ ID NO: 27170 - protein, 108 aa, Artificial Sequence
  Description of Artificial Sequence: Synthetic polypeptide
EIVLTQSPGTLSLSPGERATLSCRASQSVYSNYLAWYQQKPGQAPRLLIYGASSRATGIPDRFGGSGSGTDFTLAISRLEPEDFTIYYCQQYEDSPWTFGQGTKVEIK

SEQ ID NO: 27171 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatactgcatccaatttgcaaagtggggtcccatcaaggttcagcggcagtggatctgggacagatttcactctcaccatcagcagcgtgcagcctgaagattttgcaacttactattgtcaacaggctaacagtttcccattcactttcggccctgggaccaaagtggatatcaaa

SEQ ID NO: 27172 - protein, 107 aa, Artificial Sequence
  Description of Artificial Sequence: Synthetic polypeptide
DIQMTQSPSSVSASVGDRVTITCRASQGISSWLAWYQQKPGKAPKLLIYTASNLQSGVPSRFSGSGSGTDFTLTISSVQPEDFATYYCQQANSFPFTFGPGTKVDIK

SEQ ID NO: 27173 - DNA, 321 bp, Artificial Sequence
  Description of Artificial Sequence: Synthetic polynucleotide
gacatccagatgacccattctccatcttccctgtctgcatctgtaggagacagagtcaccatcacttgccgggcaagtcagaacattagtaattatgttaattggtatcagcagaaaccagggaaagcccctaagttcctgatctatattgcatcgagtttgcaaagtggggtctcgtcacggttcagtggcagtggatctgggacagatttcactctcaccatcagcagtgtgcaccgtgacgattttgcaatttactactgtcagcagtattactttaccccattcactttcggccgtgggaccaaagtggatatcaaa

SEQ ID NO: 27174 - protein, 107 aa, Artificial Sequence
  Description of Artificial Sequence: Synthetic polypeptide
DIQMTHSPSSLSASVGDRVTITCRASQNISNYVNWYQQKPGKAPKFLIYIASSLQSGVSSRFSGSGSGTDFTLTISSVHRDDFAIYYCQQYYFTPFTFGRGTKVDIK

SEQ ID NO: 27175 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttggcctggtttcagcagaaaccagggaaagcccctaagtccctgatctacgctgcatccagtttgcaaagtggggtcccatcaaagttcagcggcagtggatctgggacagatttcactctcaccatcagcagcctgcagcctgaagattttgcaacttattactgcctacattatcttaattacccgctcactttcggcggagggaccagggtggagatcaaa

SEQ ID NO: 27176 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCLHYLNYPLTFGGGTRVEIK

SEQ ID NO: 27177 - DNA, 321 bp, Artificial Sequence
  Description of Artificial Sequence: Synthetic polynucleotide
gacatccagatgactcagtgtccatcttccgtgtctgcatctgtaggagacagagtcaccatcacttgtcgggtgagtcagggtattagcagctggttagcctggtatcagcagaaaccagggaaagcccttaagctcgtgatctatactgcatccaatttgcaaagtggggtcccatcaaggttcagcggcagtggatctgggacagatttcactctcaccatcagcagcgtgcagcgtgaagattttgcaacttactattgtcaacaggataacagtttcccattcactttcggccgagggaccaaagtggatatcaaa

SEQ ID NO: 27178 - protein, 107 aa, Artificial Sequence
  Description of Artificial Sequence: Synthetic polypeptide
DIQMTQCPSSVSASVGDRVTITCRVSQGISSWLAWYQQKPGKALKLVIYTASNLQSGVPSRFSGSGSGTDFTLTISSVQREDFATYYCQQDNSFPFTFGRGTKVDIK

SEQ ID NO: 27179 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttactcagctccaacaataagaactacttagcttggcaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtctgcaatattttagtactccgtggacgttcggccaagggaccaaggtggaaatcaaa

SEQ ID NO: 27180 - protein, 113 aa, Artificial Sequence
  Description of Artificial Sequence: Synthetic polypeptide
DIVMTQSPDSLAVSLGERATINCKSSQSILLSSNNKNYLAWHQQKPGQPPKLLIYWASTRESGVPDRFSGSGSGTDFTLTISSLQAEDVAVYYCLQYFSTPWTFGQGTKVEIK

SEQ ID NO: 27181 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagtaattatttggcctggtttcagcagaaaccagggaaagcccctaagtccctgatctacgctgcatccaatttgcaaagtggggtcccatcaaagttcagcggcagtgggtctgggacagatttcactctcaccatcagcagcctgcagcctgaagattttgcaacttattactgcctacattatcttaattacccactcactttcggcggagggaccaaggtggagatcaaa

SEQ ID NO: 27182 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASNLQSGVPSKFSGSGSGTDFTLTISSLQPEDFATYYCLHYLNYPLTFGGGTKVEIK

SEQ ID NO: 27183 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattgaaaatgatttaggctggtatcagcagaagccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggtgggaccaaggtggagatcaaa

SEQ ID NO: 27184 - protein, 107 aa, Artificial Sequence
  Description of Artificial Sequence: Synthetic polypeptide
DIQMTQSPSSLSASVGDRVTITCRASQGIENDLGWYQQKPGKAPKRLIYAASSLQSGVPSRFSGSGSGTEFTLTISSLQPEDFATYYCLQHNSYPLTFGGGTKVEIK

SEQ ID NO: 27185 - DNA, 321 bp, Artificial Sequence
  Description of Artificial Sequence: Synthetic polynucleotide
gacatccagatgacccagtctccatcctccctgtctgcatctgtgggagacagagtcaccatcacttgccgggcaagtcagggcattagtaatgatttaggctggtatcagcagaagccagggaaagcccctaagcgcctgatctatgctgcatccagtttgcaaagtggggtcccatcaaggttcagcggcagtggatctgggacagaattcactctcacaatcagcagcctgcagcctgaagattttgcaacttatcactgtctacagcataatagttatcctcctactttcggcggagggaccaaggtggagatcaaa

SEQ ID NO: 27186 - protein, 107 aa, Artificial Sequence
  Description of Artificial Sequence: Synthetic polypeptide
DIQMTQSPSSLSASVGDRVTITCRASQGISNDLGWYQQKPGKAPKRLIYAASSLQSGVPSRFSGSGSGTEFTLTISSLQPEDFATYHCLQHNSYPPTFGGGTKVEIK

SEQ ID NO: 27187 - DNA, 321 bp, Artificial Sequence
  Description of Artificial Sequence: Synthetic polynucleotide
gccatccagatgacccagtctccatcctccctgtctgcatctgtaggagacagagtcaccatcacttgccgggcaagtcagggcattagagatgatttaggctggtatcagcagaaaccagggaaagcccctaagcgcctgatctatgctgcatccagtttgcaaagtggggtcccgtcaaggatcagcggcagtggatctgggacagaattcactctcacaatcagcagcctgcagcctgaagattttgcaatttattactgtctacagcattatagttaccctcggacgttcggccaagggaccaaggtggaaatcaaa

SEQ ID NO: 27188 - protein, 107 aa, Artificial Sequence
  Description of Artificial Sequence: Synthetic polypeptide
AIQMTQSPSSLSASVGDRVTITCRASQGIRDDLGWYQQKPGKAPKRLIYAASSLQSGVPSRISGSGSGTEFTLTISSLQPEDFAIYYCLQHYSYPRTFGQGTKVEIK

SEQ ID NO: 27189 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctggtcagagcctcctgcatagtgatggaaagacctttttgtcttggtacctgcagaagccaggccagcctccacagctcctgatctatgaaatttccaaccggttctctggagtgccagataggttcagtggcagcgggtcagggacagatttcacactgaaaatcagccgggtggaggctgaggatgttgggattttttactgcatgcaaagtacacagcttcctcggacgttcggccaagggaccaaggtggaaatcaaa

SEQ ID NO: 27190 - protein, 112 aa, Artificial Sequence
  Description of Artificial Sequence: Synthetic polypeptide
DIVMTQTPLSLSVTPGQPASISCKSGQSLLHSDGKTFLSWYLQKPGQPPQLLIYEISNRFSGVPDRFSGSGSGTDFTLKISRVEAEDVGIFYCMQSTQLPRTFGQGTKVEIK

SEQ ID NO: 27191 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgctacatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 27192 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYATSSLQSGVPSRFSGSGSGTEFTLTISSLQPEDFATYYCLQHNSYPLTFGGGTKVEIK

SEQ ID NO: 27193 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcaacagaaaccagggaaagcccctgagcgcctgatctatgctgcatccagtttgcaaagtggggtcccatcaaggttcagcggcagtggatctgggacagaattcactctcacaatcagcagcctgcagcctgaagattttgcaacttattactgtcttcagcattataattaccctcgggcgttcggccaagggaccaaggtggaaatcaaa

SEQ ID NO: 27194 - protein, 107 aa, Artificial Sequence
  Description of Artificial Sequence: Synthetic polypeptide
DIQMTQSPSSLSASVGDRVTITCRASQGIRNDLGWYQQKPGKAPERLIYAASSLQSGVPSRFSGSGSGTEFTLTISSLQPEDFATYYCLQHYNYPRAFGQGTKVEIK

SEQ ID NO: 27195 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaatttcaactacttaacttggtatcagcagaaaccaggacagcctcctaagttgctcatttactgggcatctacccgggaatccggggtccctgaccgattcagtggcagcgggtctgggacagatttcactctcaccatcaacagcctgcaggctgaagatgtggcagtttattactgtcagcaatattatagtactcctccgacgttcggccaagggaccaaggtggaaatcaaa

SEQ ID NO: 27196 - protein, 113 aa, Artificial Sequence
  Description of Artificial Sequence: Synthetic polypeptide
DIVMTQSPDSLAVSLGERATINCKSSQSVLYSSNNFNYLTWYQQKPGQPPKLLIYWASTRESGVPDRFSGSGSGTDFTLTINSLQAEDVAVYYCQQYYSTPPTFGQGTKVEIK

SEQ ID NO: 27197 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccgtggacgttcggcccagggaccaaggtggaaatcaaa

SEQ ID NO: 27198 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGPGTKVEIK

SEQ ID NO: 27199 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgatggaaagacctttttgtattggttcctgcagaagccaggccagcctccacagctcctgatctatgaaatttccaaccggttctctggagtgccagataggttcagtggcagcgggtcagggacagatttcacactgaaaatcagccgggtggaggctgaggatgttgggatttattactgcatgcaaagtacacagcttcctcggacgttcggccaagggaccaaggtggaaatcaaa

SEQ ID NO: 27200 - protein, 112 aa, Artificial Sequence
  Description of Artificial Sequence: Synthetic polypeptide
DIVMTQTPLSLSVTPGQPASISCKSSQSLLHSDGKTFLYWFLQKPGQPPQLLIYEISNRFSGVPDRFSGSGSGTDFTLKISRVEAEDVGIYYCMQSTQLPRTFGQGTKVEIK

SEQ ID NO: 27201 - DNA, 339 bp, Artificial Sequence
  Description of Artificial Sequence: Synthetic polynucleotide
gacatcgtgatgacccagtctccagactccctggctgtttctctgggcgagagggccgccatcaactgcaagtccagccagagtgttttatacagctccaacaataagaactacttagcttggtaccagcagaaaccaggacagcctcctaagctgctcatttattggtcgtctacccggaaatccggggtccctgaccgattcagtggcagcgggtctgggacagatttcactctcaccatcagcagcctgcaggctgaagatgtggcagtttattactgtcagcaatattttagtactcctccgacgttcggccaagggaccaaggtggaaatcaaa

SEQ ID NO: 27202 - protein, 113 aa, Artificial Sequence
  Description of Artificial Sequence: Synthetic polypeptide
DIVMTQSPDSLAVSLGERAAINCKSSQSVLYSSNNKNYLAWYQQKPGQPPKLLIYWSSTRKSGVPDRFSGSGSGTDFTLTISSLQAEDVAVYYCQQYFSTPPTFGQGTKVEIK

SEQ ID NO: 27203 - DNA, 339 bp, Artificial Sequence
  Description of Artificial Sequence: Synthetic polynucleotide
gacatcgtgatgacccagtctccagactccctggctgcgtctctgggcgagagggccaccatcacctgcaagtccagccagagtgttttatacaattccaacaataagaactacttagcttggtaccagcagaaaccaggacagcctcctaagctgctcatttactgggcatctacccgggagtccggggtccctgaccgattcagtggcagcgggtctgggacagatttcactctcaccatcagcagcctgcaggctgaagatgtggcaatttattactgtcaacaatattatattaatccgtgcagttttggccaggggaccaggctggagatcaaa

SEQ ID NO: 27204 - protein, 113 aa, Artificial Sequence
  Description of Artificial Sequence: Synthetic polypeptide
DIVMTQSPDSLAASLGERATITCKSSQSVLYNSNNKNYLAWYQQKPGQPPKLLIYWASTRESGVPDRFSGSGSGTDFTLTISSLQAEDVAIYYCQQYYINPCSFGQGTRLEIK

SEQ ID NO: 27205 - DNA, 321 bp, Artificial Sequence
  Description of Artificial Sequence: Synthetic polynucleotide
gacatcctgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttacaaagtggggtcccatcgcggttcagcggcagtggatctgggacagaattcactctcacaatcagcagcctgcagcctgaagattttgcaacttattactgtctacaacataatagttacccgctcacttttggcggagggaccaaggtggagatcaaa

SEQ ID NO: 27206 - protein, 107 aa, Artificial Sequence
  Description of Artificial Sequence: Synthetic polypeptide
DILMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 27207 - DNA, 336 bp, Artificial Sequence
  Description of Artificial Sequence: Synthetic polynucleotide
gattttgtgatgacccagactccactctctctgtccgtcacccctggacagccggcctccatctcctgcaagtctagtcagagcctcctgcatagtgatggaaagacctttttgtattggtacctgcagaagccaggccagcctccacagctcctgatctatgaaatttccaaccggttctctggagtgccagataggttcagtggcagcgggtcagggacagatttcacactgaaaatcagccgggtggaggctgaggatgttgggatttattactgcatgcaaagtacacagcttcctcggacgttcggccaagggaccaaggtggaaatcaaa

SEQ ID NO: 27208 - protein, 112 aa, Artificial Sequence
  Description of Artificial Sequence: Synthetic polypeptide
DFVMTQTPLSLSVTPGQPASISCKSSQSLLHSDGKTFLYWYLQKPGQPPQLLIYEISNRFSGVPDRFSGSGSGTDFTLKISRVEAEDVGIYYCMQSTQLPRTFGQGTKVEIK

SEQ ID NO: 27209 - DNA, 339 bp, Artificial Sequence
  Description of Artificial Sequence: Synthetic polynucleotide
aacatcgtgatgacccagtctccagactccctggctgtgtctctggacgagagggccaccatcaactgcaagtccagccagagtgttttatccagctccaacaatcacaactacttagcttggtaccagcagaaaccaggacagcctcctaagatgctcatttactgggcatctacccgggaatccggggtccctgaccgattcagtggcagcgggtctgggacagatttcactctcaccatcagcagcctgcaggctgaagatgtggcagtttattactgtcagcaatattatactactccgtgcagttttggccaggggaccaagctggagatcaaa

SEQ ID NO: 27210 - protein, 113 aa, Artificial Sequence
  Description of Artificial Sequence: Synthetic polypeptide
NIVMTQSPDSLAVSLDERATINCKSSQSVLSSSNNHNYLAWYQQKPGQPPKMLIYWASTRESGVPDRFSGSGSGTDFTLTISSLQAEDVAVYYCQQYYTTPCSFGQGTKLEIK

SEQ ID NO: 27211 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgatggaaagacctttttgtattggtacctgcagaagccaggccagcctccacagctcctgatctatgaaatttccaaccggttctctggagtgccagataggttcagtggcagcgggtcagggacagatttcacactgaaaatcagccgggtggaggctgaggatgttgggatttattactgcatgcaaagtacacagcttcctcggacgttcggccaagggaccaaggtggaaatcaaa

SEQ ID NO: 27212 - protein, 112 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEISNRFSGVPDRFSGSGSGTDFTLKISRVEAEDVGIYYCMQSTQLPRTFGQGTKVEIK

SEQ ID NO: 27213 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagagatgatttaggctggtatcagcagataccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctgcagcattatagttaccctcggacgttcggccaagggaccaaggtggaaatcaaa

SEQ ID NO: 27214 - protein, 107 aa, Artificial Sequence
  Description of Artificial Sequence: Synthetic polypeptide
DIQMTQSPSSLSASVGDRVTITCRASQGIRDDLGWYQQIPGKAPKRLIYAASSLQSGVPSRFSGSGSGTEFTLTISSLQPEDFATYYCLQHYSYPRTFGQGTKVEIK

SEQ ID NO: 27215 - DNA, 327 bp, Artificial Sequence
  Description of Artificial Sequence: Synthetic polynucleotide
gaaattgtgctgacgcagtctccaggcaccctgtctttgtctccaggggaaagagccaccctctcctgcagggccagtcagaatcttagcagcagctacttaggctggtaccagcagaaacctggccaggctcccagactcctcatctatgatacatccagcagggccactggcatcccagacaggttcagtggcagtgggtctgggacagacttcactctcaccatcagcagactggagcctgaagattttgcagtgtattactgtcaggagtatggtagctcactcatgtgcagttttggccaggggaccaagctggagatcaaa

SEQ ID NO: 27216 - protein, 109 aa, Artificial Sequence
  Description of Artificial Sequence: Synthetic polypeptide
EIVLTQSPGTLSLSPGERATLSCRASQNLSSSYLGWYQQKPGQAPRLLIYDTSSRATGIPDRFSGSGSGTDFTLTISRLEPEDFAVYYCQEYGSSLMCSFGQGTKLEIK

SEQ ID NO: 27217 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatatagctccaacaataagaactacttagcttggtaccagcagaaaccaggacagcctcctaaactactcatttactgggcatctacccgggaatccggggtccctgaccgattcactggcagcgggtctgggacagatttcactctcaccatcagctgcgtgcagccggaagatgtggcagtttattactgtcaccaatatcataattctcctcccactttcggccacgggaccgaagtggatatcaaa

SEQ ID NO: 27218 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFTGSGSGTDFTLTISCVQPEDVAVYYCHQYHNSPPTFGHGTEVDIK

SEQ ID NO: 27219 - DNA, 336 bp, Artificial Sequence; identical to SEQ ID NO: 27211
  Description of Artificial Sequence: Synthetic polynucleotide

SEQ ID NO: 27220 - protein, 112 aa, Artificial Sequence; identical to SEQ ID NO: 27212
  Description of Artificial Sequence: Synthetic polypeptide

SEQ ID NO: 27221 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatgttttatacaactccaacaataacaactacttagcttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttatttctgtcagcaatattatagttctcctccgacgttcggccaagggaccaaggtggaaatcaac

SEQ ID NO: 27222 - protein, 113 aa, Artificial Sequence
  Description of Artificial Sequence: Synthetic polypeptide
DIVMTQSPDSLAVSLGERATINCKSSQNVLYNSNNNNYLAWYQQKPGQPPNLLIYWASTRESGVPDRFSGSGSGTDFTLTISSLQAEDVAVYFCQQYYSSPPTFGQGTKVEIN

SEQ ID NO: 27223 - DNA, 321 bp, Artificial Sequence
  Description of Artificial Sequence: Synthetic polynucleotide
gacatccagatgacccagtctccatcctccctgtctgcatctgtaggagacagagtcatcatcacttgccgggcaagtcagggcatgagaaaagatttaggctggtatcagcagaaaccagggaaagcccctaagcgcctgatctatgctgcaaccagtttgcaaagtggggtcccatcaaggttcagcggcagtggatctgggacagaattcactctcacaatcagcagcctgcagcctgaagattttgcaacttattactgtctacagcataatagttatccattcactttcggccctgggaccaaagtggatatcaaa

SEQ ID NO: 27224 - protein, 107 aa, Artificial Sequence
  Description of Artificial Sequence: Synthetic polypeptide
DIQMTQSPSSLSASVGDRVIITCRASQGMRKDLGWYQQKPGKAPKRLIYAATSLQSGVPSRFSGSGSGTEFTLTISSLQPEDFATYYCLQHNSYPFTFGPGTKVDIK

SEQ ID NO: 27225 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttacaaagtggggtcccatcaaggttcagcggcagtggatctgggacagaattcactctcacaatcagcagcctgcagcctgaagattttgcaacttattgctgtcttcagcataatacttacccattcactttcggccctgggaccaaagtggatatcaaa

SEQ ID NO: 27226 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYCCLQHNTYPFTFGPGTKVDIK

SEQ ID NO: 27227 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgtttacagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtatattactgtcagcagtatggtacctcacctcggacgttcggccaagggaccaaggtggaaatcaaa

SEQ ID NO: 27228 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGSGTDFTLTISRLEPEDFAVYYCQQYGTSPRTFGQGTKVEIK

SEQ ID NO: 27229 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatatatgctgcatccagtttgctaggtggtgtcccatcaagattcagcggcagtggatctgggacagaattcactctcacaatcagcagcctgcagcctgaagattttgcaacttattactgtctacaacataatagttacccattcactttcggccctgggaccaaggtggatatcaaa

SEQ ID NO: 27230 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLLGGVPSRFSGSGSGTEFTLTISSLQPEDFATYYCLQHNSYPFTFGPGTKVDIK

SEQ ID NO: 27231 - DNA, 339 bp, Artificial Sequence
  Description of Artificial Sequence: Synthetic polynucleotide
gacatcgtgatgacccagtctccagattccctggctgtgtctctgggcgagagggccaccatcaactgcaagtccagccagagtgttttatacagctccaacaataacaactacttagcttggtaccaacaaaaaccaggacagcctcctaagctgctcattttctgggcatctacccgggaatccggggtccctgaccgattcagtggcagcgggtctgggacagatttcactctcaccatcagcagcctgcaggctgaagatgtggcagtttattactgtcaacactccaagagtattcctggtaagtttgggcaggggatcaaactggagatccaa

SEQ ID NO: 27232 - protein, 113 aa, Artificial Sequence
  Description of Artificial Sequence: Synthetic polypeptide
DIVMTQSPDSLAVSLGERATINCKSSQSVLYSSNNNNYLAWYQQKPGQPPKLLIFWASTRESGVPDRFSGSGSGTDFTLTISSLQAEDVAVYYCQHSKSIPGKFGQGIKLEIQ

SEQ ID NO: 27233 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaattacaactacttagcttggtaccagcagagaccaggacagcctcctaagctgctcatttactgggcttctacccgggaatccggggtccctgaccgattcagtggcagcgggtctgggccagatttcactctcaccatcagcagcctgcaggctgaagatgtggcagtttattactgtcagcaatattatactactcctccgacgttcggccaagggaccaaggtggaaatcaaa

SEQ ID NO: 27234 - protein, 113 aa, Artificial Sequence
  Description of Artificial Sequence: Synthetic polypeptide
DIVMTQSPDSLAVSLGERATINCKSSQSVLYSSNNYNYLAWYQQRPGQPPKLLIYWASTRESGVPDRFSGSGSGPDFTLTISSLQAEDVAVYYCQQYYTTPPTFGQGTKVEIK

SEQ ID NO: 27235 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacagctccaacaatcagaactacttagcttggtaccagcagaaaccaggacagcctcctaggctgctcatttactggacatctacccgggaatccggggtccctgaccgattcagtggcagcgggtctgggacagatttcactctcaccatcagcaacctgcaggctgaagatgtggctgtttattactgtcagcaatattatattactccgtgcagttttggccaggggaccaaactggagatcaaa

SEQ ID NO: 27236 - protein, 113 aa, Artificial Sequence
  Description of Artificial Sequence: Synthetic polypeptide
DIVMTQSPDSLAVSLGERATINCKSSQSVLYSSNNQNYLAWYQQKPGQPPRLLIYWTSTRESGVPDRFSGSGSGTDFTLTISNLQAEDVAVYYCQQYYITPCSFGQGTKLEIK

SEQ ID NO: 27237 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttatacaactccaacaataacaactacttagcttggtaccagcagaaaccaggacagcctcctaacctgctcatttactgggcatctacccgggaatccggggtccctgaccgattcagtggcagcgggtctgggacagatttcactctcaccatcagcagcctgcagactgaagatgtggcagtttattactgtcagcaatattatattactccgtgcagttttggccaggggaccaagctggagatcaaa

SEQ ID NO: 27238 - protein, 113 aa, Artificial Sequence
  Description of Artificial Sequence: Synthetic polypeptide
DIVMTQSPDSLAVSLGERATINCKSSQSVLYNSNNNNYLAWYQQKPGQPPNLLIYWASTRESGVPDRFSGSGSGTDFTLTISSLQTEDVAVYYCQQYYITPCSFGQGTKLEIK

SEQ ID NO: 27239 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtacctgcagaggccaggccagcctccacagctcctgatcaatgaagtttccatccggttctctggagtgccagataggttcagtggcagcgggtcagggacagatttcacactgaaaatcagccgggtggaggctgaggatgttggggtttactactgcatgcaaagtatacagattccgtggacgttcggccaggggaccaaggtggacatcaaa

SEQ ID NO: 27240 - protein, 112 aa, Artificial Sequence
  Description of Artificial Sequence: Synthetic polypeptide
DIVMTQTPLSLSVTPGQPASISCKSSQSLLHGDGKTYLYWYLQRPGQPPQLLINEVSIRFSGVPDRFSGSGSGTDFTLKISRVEAEDVGVYYCMQSIQIPWTFGQGTKVDIK

SEQ ID NO: 27241 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctacatggtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagattccgtggacgttcggccaagggaccaaggtggagatcaaa

SEQ ID NO: 27242 - protein, 112 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGVYYCMQSIQIPWTFGQGTKVEIK

SEQ ID NO: 27243 - DNA, 321 bp, Artificial Sequence
  Description of Artificial Sequence: Synthetic polynucleotide
gacatccagatgacccagtctccatcctccctgtctgcatctataggagacagagtcaccatcacttgccgggcaagtcagggcattagaaatgatttaggctggtatcagcagaaaccagggaaagcccctaagcgcctgatctatgctgcatccagtttgcaaagtgggctcccatcaaggttcagcggcagtggatctgggacagaattcactctcacaatcagcaacctgcagcctgaagattttgcaacttattactgtctacagcattataattaccctcgggcgttcggccaagggaccaaggtggaaatccaa

SEQ ID NO: 27244 - protein, 107 aa, Artificial Sequence
  Description of Artificial Sequence: Synthetic polypeptide
DIQMTQSPSSLSASIGDRVTITCRASQGIRNDLGWYQQKPGKAPKRLIYAASSLQSGLPSRFSGSGSGTEFTLTISNLQPEDFATYYCLQHYNYPRAFGQGTKVEIQ

SEQ ID NO: 27245 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaggtccagccagagtattttatacatctccaacaataagaactacttagcttggtaccagcagaaaccaggacagcctcctaagatgctcatttactgggcatctacccgggaatccggggtccctgaccgattcagtggcagcgggtctgggacagatttcactctcaccatcagcagcctgcaggctgaagatgtggcagtttattactgtcagcaatattatagttctccgtgcagttttggccaggggaccaagctggagatcaaa

SEQ ID NO: 27246 - protein, 113 aa, Artificial Sequence
  Description of Artificial Sequence: Synthetic polypeptide
DIVMTQSPDSLAVSLGERATINCRSSQSILYISNNKNYLAWYQQKPGQPPKMLIYWASTRESGVPDRFSGSGSGTDFTLTISSLQAEDVAVYYCQQYYSSPCSFGQGTKLEIK

SEQ ID NO: 27247 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttatacagctccaacaattacaactacttagcttggtaccagcagaagccaggacagcctcctaagctgctcatttactgggcttctacccgggaatccggggtccctgaccgattcagtggcagcgggtctgggccagatttcactctcaccatcagcagcctgcaggctgaagatgtggcagtttattactgtcagcaatattatactactcctccgacgttcggccaagggaccaaggtggaaatcaaa

SEQ ID NO: 27248 - protein, 113 aa, Artificial Sequence
  Description of Artificial Sequence: Synthetic polypeptide
DIVMTQSPDSLAVSLGERATINCKSSQSILYSSNNYNYLAWYQQKPGQPPKLLIYWASTRESGVPDRFSGSGSGPDFTLTISSLQAEDVAVYYCQQYYTTPPTFGQGTKVEIK

SEQ ID NO: 27249 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatggtgatggaaagacctatttgtattggtaccagcagaagccaggccagcctccacagatcctgatctatgaagtttccaaccggttctctggagtgccagataggttcagtggcagcgggtcagggacagacttcacactgaaaatcagccgggtggaggctgaggatgttggggtttattactgcatgcaaagtatacaggttccgtggacgttcggccaagggaccaaggtggagatcaaa

SEQ ID NO: 27250 - protein, 112 aa, Artificial Sequence
  Description of Artificial Sequence: Synthetic polypeptide
DIVMTQTPLSLSVTPGQPASISCKSSQSLLHGDGKTYLYWYQQKPGQPPQILIYEVSNRFSGVPDRFSGSGSGTDFTLKISRVEAEDVGVYYCMQSIQVPWTFGQGTKVEIK

SEQ ID NO: 27251 - DNA, 321 bp, Artificial Sequence
  Description of Artificial Sequence: Synthetic polynucleotide
gacatccagatgacccagtctccatcctccctgtctgcatctgttggagacagagtcaccatcacttgccgggcaagtcagggcattgggaatgatttaggctggtatcagcagaaaccagggaaagcccctaagcgcctgatctatgctgcctccagtttgcaaagtggggtcccatcaaggttcagcggcagtgtatctgggacagaattcattctcacaatcagcagcctgcagcctgaagattttgcaacttattactgtctacatcattatagttaccctcggacgttcggccaggggaccaaggtggaaatcaaa

SEQ ID NO: 27252 - protein, 107 aa, Artificial Sequence
  Description of Artificial Sequence: Synthetic polypeptide
DIQMTQSPSSLSASVGDRVTITCRASQGIGNDLGWYQQKPGKAPKRLIYAASSLQSGVPSRFSGSVSGTEFILTISSLQPEDFATYYCLHHYSYPRTFGQGTKVEIK

SEQ ID NO: 27253 - DNA, 336 bp, Artificial Sequence; identical to SEQ ID NO: 27211
  Description of Artificial Sequence: Synthetic polynucleotide

SEQ ID NO: 27254 - protein, 112 aa, Artificial Sequence; identical to SEQ ID NO: 27212
  Description of Artificial Sequence: Synthetic polypeptide

SEQ ID NO: 27255 - DNA, 321 bp, Artificial Sequence; identical to SEQ ID NO: 24295
  Description of Artificial Sequence: Synthetic polynucleotide

SEQ ID NO: 27256 - protein, 107 aa, Artificial Sequence; identical to SEQ ID NO: 24296
  Description of Artificial Sequence: Synthetic polypeptide

SEQ ID NO: 27257 - DNA, 336 bp, Artificial Sequence; identical to SEQ ID NO: 27211
  Description of Artificial Sequence: Synthetic polynucleotide

SEQ ID NO: 27258 - protein, 112 aa, Artificial Sequence; identical to SEQ ID NO: 27212
  Description of Artificial Sequence: Synthetic polypeptide

SEQ ID NO: 27259 - DNA, 336 bp, Artificial Sequence
  Description of Artificial Sequence: Synthetic polynucleotide
gatattgtgatgacccagactccactctctctgtccgtcatccctggacagccggcctccatctcctgcaagtctagtcagagcctcctgcatagtgatggaaagacctttttgtattggtacctgcagaggccaggccagcctccacagctcctgatctatgaagtttccaaccggttctctggagtgccagataggttcagtggcagcgggtcagggacagatttcacactgaaaatcagccgggtggaggctgaggatgttgggatttattactgcatgcaaagtacacagcttcctcggacgttcggccaagggaccaaggtggaaatcaaa

SEQ ID NO: 27260 - protein, 112 aa, Artificial Sequence
  Description of Artificial Sequence: Synthetic polypeptide
DIVMTQTPLSLSVIPGQPASISCKSSQSLLHSDGKTFLYWYLQRPGQPPQLLIYEVSNRFSGVPDRFSGSGSGTDFTLKISRVEAEDVGIYYCMQSTQLPRTFGQGTKVEIK

SEQ ID NO: 27261 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgatggaaagacctttttgtattggtacctgcagaagccaggccagcctccacagctcctgatctatgaaatttccaaccggttctctggggtgccagataggttcagtggcagcgggtcagggacagatttcacactgaaaatcagccgagtggaggctgaggatgttgggatttattactgcatgcaaagtacacagcttcctcggacgttcggccaagggaccaaggtggaaatcaaa

SEQ ID NO: 27262 - protein, 112 aa, Artificial Sequence; identical to SEQ ID NO: 27212
  Description of Artificial Sequence: Synthetic polypeptide

SEQ ID NO: 27263 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagaatgttttacacagctccaacagtaataactacttagtttggtaccagcagaaaccaggacagcctcctaaactgctcatttactgggcatctacccgggaatccggggtccctgaccgattcagaggcagcgggtctgggacagatttcactctcaccatcagcagcctgcaggctgaagatgtggcagtttattactgtcagcaatattataaaactccgtggacgttcggccaagggaccaaggtggaaatcaaa

SEQ ID NO: 27264 - protein, 113 aa, Artificial Sequence
  Description of Artificial Sequence: Synthetic polypeptide
DIVMTQSPDSLAVSLGERATINCKSSQNVLHSSNSNNYLVWYQQKPGQPPKLLIYWASTRESGVPDRFRGSGSGTDFTLTISSLQAEDVAVYYCQQYYKTPWTFGQGTKVEIK

SEQ ID NO: 27265 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgatggaaagacctttttgtattggtacctgcacaagccaggccagcctccacacctcctgatctatgaaatttccaaccggttctctggagtgccagataggttcagtggcagcgggtcagggacagatttcacactgaaaatcagccgggtggaggctgaggatgttgggatttattactgcatgcaaagtacacagcttcctcggacgttcggccaagggaccaaggtggaaatcaaa

SEQ ID NO: 27266 - protein, 112 aa, Artificial Sequence
  Description of Artificial Sequence: Synthetic polypeptide
DIVMTQTPLSLSVTPGQPASISCKSSQSLLHSDGKTFLYWYLHKPGQPPHLLIYEISNRFSGVPDRFSGSGSGTDFTLKISRVEAEDVGIYYCMQSTQLPRTFGQGTKVEIK

SEQ ID NO: 27267 - DNA, 321 bp, Artificial Sequence
  Description of Artificial Sequence: Synthetic polynucleotide
gacatccagatgacccagtctccatcctccctgtctgcatctgtaggagacagagtcaccatcacttgccggacaagtcagggcattagaaatgatttaggctggtatcagcagaaaccagggaaagcccctaagcgcctgatctatgctgcatccagtttgcaaagtggggtcccatcaaggttcagtggcagtggatctgggacagatttcactctcacaatcagcagcctgcagcctgaagattttgcaacttattactgtctacagcattatagttaccctcggacgttcggccaagggaccaaggtggaaatcaaa

SEQ ID NO: 27268 - protein, 107 aa, Artificial Sequence
  Description of Artificial Sequence: Synthetic polypeptide
DIQMTQSPSSLSASVGDRVTITCRTSQGIRNDLGWYQQKPGKAPKRLIYAASSLQSGVPSRFSGSGSGTDFTLTISSLQPEDFATYYCLQHYSYPRTFGQGTKVEIK

SEQ ID NO: 27269 - DNA, 339 bp, Artificial Sequence
  Description of Artificial Sequence: Synthetic polynucleotide
gacatcgtgatgacccagtctccagactccctggctgtgtctctcggcgagagggccaccatcaactgcaagtccagccagaatgttttatacagttccaacaataacaactacttagcttggtaccagcagacacctggacagcctcctaagctgctcttttactgggcatctacccggaaatccggggtccctgaccgattcagtggcagcgggtctgggacagatttcactctcaccatcagcagcctgcaggctgaagatgtggcagtttattactgtcagcaatattatagtagtcctccgacgttcggccaagggaccaaggtggaaatcaaa

SEQ ID NO: 27270 - protein, 113 aa, Artificial Sequence
  Description of Artificial Sequence: Synthetic polypeptide
DIVMTQSPDSLAVSLGERATINCKSSQNVLYSSNNNNYLAWYQQTPGQPPKLLFYWASTRKSGVPDRFSGSGSGTDFTLTISSLQAEDVAVYYCQQYYSSPPTFGQGTKVEIK

SEQ ID NO: 27271 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtaagaccctcctgcatagtgatggaaagacctttttgtattggtacctgcagaagccaggccagcctccacagcccctgatctatgaaatttccaaccggttctctggagtgccagataggttcagtggcagcgggtcagggacagatttcacactgaaaatcagccgggtggaggctgaggatgttgggatttattactgcatgcaaagtacacagcttcctcggacgttcggccaagggaccaaggtggaaatcaaa

SEQ ID NO: 27272 - protein, 112 aa, Artificial Sequence
  Description of Artificial Sequence: Synthetic polypeptide
DIVMTQTPLSLSVTPGQPASISCKSSKTLLHSDGKTFLYWYLQKPGQPPQPLIYEISNRFSGVPDRFSGSGSGTDFTLKISRVEAEDVGIYYCMQSTQLPRTFGQGTKVEIK

SEQ ID NO: 27273 - DNA, 336 bp, Artificial Sequence; identical to SEQ ID NO: 27211
  Description of Artificial Sequence: Synthetic polynucleotide

SEQ ID NO: 27274 - protein, 112 aa, Artificial Sequence; identical to SEQ ID NO: 27212
  Description of Artificial Sequence: Synthetic polypeptide

SEQ ID NO: 27275 - DNA, 336 bp, Artificial Sequence; identical to SEQ ID NO: 27211
  Description of Artificial Sequence: Synthetic polynucleotide

SEQ ID NO: 27276 - protein, 112 aa, Artificial Sequence; identical to SEQ ID NO: 27212
  Description of Artificial Sequence: Synthetic polypeptide

SEQ ID NO: 27277 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgcagattttgcaacttattactgtctacaccataatagttacccattcactttcggccctgggaccaaagtggatatcaaa

SEQ ID NO: 27278 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPADFATYYCLHHNSYPFTFGPGTKVDIK

SEQ ID NO: 27279 - DNA, 321 bp, Artificial Sequence
  Description of Artificial Sequence: Synthetic polynucleotide
gacatcctgatgacccagtctccatcttccgtgtctgcatctgtaggagacagagtcaccatcacttgtcgggcgagtcagggtattatcaactggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaatttactattgtcaacaggctaacagtttcccgtggacgttcggccaagggaccaaggtggaaatcaaa

SEQ ID NO: 27280 - protein, 107 aa, Artificial Sequence
  Description of Artificial Sequence: Synthetic polypeptide
DILMTQSPSSVSASVGDRVTITCRASQGIINWLAWYQQKPGKAPKLLIYAASSLQSGVPSRFSGSGSGTDFTLTISSLQPEDFAIYYCQQANSFPWTFGQGTKVEIK

SEQ ID NO: 27281 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccattcactttcggccctgggaccaaagtggatatcaaa

SEQ ID NO: 27282 - protein, 107 aa, Artificial Sequence
  Description of Artificial Sequence: Synthetic polypeptide
DIQMTQSPSSLSASVGDRVTITCRASQDIRNDLGWYQQKPGKAPKRLIYAASSLQSGVPSRFSGSGSGTEFTLTISSLQPEDFATYYCLQHNSYPFTFGPGTKVDIK

SEQ ID NO: 27283 - DNA, 339 bp, Artificial Sequence
  Description of Artificial Sequence: Synthetic polynucleotide
gacatcgtgatgacccagtctccagactccctgactgtgtctctgggcgagagggccaccatcaactgcaagtccagccagagtgttttatacagctccaacgataagaactacttagcttggtaccagcagaaaccaggacagcctcctaagatgctcatttactgggcatctacccgggaatccggggtccctgaccgattcagtggcagcgggtctgggacagatttcactctcaccatcagcagcctgcaggctgaagatgtggcagtttattactgtcagcaatattatattactccgtgcagttttggccaggggaccaagctggagatcaaa

SEQ ID NO: 27284 - protein, 113 aa, Artificial Sequence
  Description of Artificial Sequence: Synthetic polypeptide
DIVMTQSPDSLTVSLGERATINCKSSQSVLYSSNDKNYLAWYQQKPGQPPKMLIYWASTRESGVPDRFSGSGSGTDFTLTISSLQAEDVAVYYCQQYYITPCSFGQGTKLEIK

SEQ ID NO: 27285 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaggtccagccagattgttttatccgactccaacaataacaactacttagcttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttatttctgtcagcaatattatagttctcctccgacgttcggccaagggaccaaggtggaaatcaaa

SEQ ID NO: 27286 - protein, 113 aa, Artificial Sequence
  Description of Artificial Sequence: Synthetic polypeptide
DIVMTQSPDSLAVSLGERATINCRSSQIVLSDSNNNNYLAWYQQKPGQPPNLLIYWASTRESGVPDRFSGSGSGTDFTLTISSLQAEDVAVYFCQQYYSSPPTFGQGTKVEIK

SEQ ID NO: 27287 - DNA, 336 bp, Artificial Sequence
  Description of Artificial Sequence: Synthetic polynucleotide
gatattgtgatgacccagactccactctctctgtccgtcacccctggacagccggcctccatctcctgcaagtctagtcagagcctcctgcatagtgatggaaagacctttttgtattggtatctgcagaagccaggccagcccccacagctcctgatctatgaaatttccaaccggttctctggggtgccagataggttcagtggcagcgggtcagggacagatttcacactgaaaatcagtcgagtggaggctgaggatgttgggatttattactgcatgcaaagtacacagcttcctcggacgttcggccaagggaccagggtggaaatcaaa

SEQ ID NO: 27288 - protein, 112 aa, Artificial Sequence
  Description of Artificial Sequence: Synthetic polypeptide
DIVMTQTPLSLSVTPGQPASISCKSSQSLLHSDGKTFLYWYLQKPGQPPQLLIYEISNRFSGVPDRFSGSGSGTDFTLKISRVEAEDVGIYYCMQSTQLPRTFGQGTRVEIK

SEQ ID NO: 27289 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaataacaactacttagcttggtatcagcagaaaccaggacagcctcctaagctgctcatttactggggatctacccgggaatccggggtccctgaccgattcagtggcagcgggtctgggacagatttcactctcaccatcagcagcctgcaggctgaagatgtggcagtttattactgtcagcaatattatagtgctccgtacagttttggccaggggaccaagttggagatcaaa

SEQ ID NO: 27290 - protein, 113 aa, Artificial Sequence
  Description of Artificial Sequence: Synthetic polypeptide
DIVMTQSPDSLAVSLGERATINCKSSQSVLHSSNNNNYLAWYQQKPGQPPKLLIYWGSTRESGVPDRFSGSGSGTDFTLTISSLQAEDVAVYYCQQYYSAPYSFGQGTKLEIK

SEQ ID NO: 27291 - DNA, 339 bp, Artificial Sequence
  Description of Artificial Sequence: Synthetic polynucleotide
gacatcgtgatgacccagtctccagactccctggctgtgtctctggacgagagggccaccatcaactgcaagtccagccagagtgttttacacagttccaacaataataactacttagcttggtaccagcagaagccaggacagcctcctaagctgctcatttactgggcatctacccgggaatccgggatccctgaccgattcagtggcagcgggtctgggacagatttcactctcaccatcagcagcctgcaggctgaggatgtggcagtttattactgtcagcaatattataatactccgtgcagttttggccaggggaccaagctggagatcaaa

SEQ ID NO: 27292 - protein, 113 aa, Artificial Sequence
  Description of Artificial Sequence: Synthetic polypeptide
DIVMTQSPDSLAVSLDERATINCKSSQSVLHSSNNNNYLAWYQQKPGQPPKLLIYWASTRESGIPDRFSGSGSGTDFTLTISSLQAEDVAVYYCQQYYNTPCSFGQGTKLEIK

SEQ ID NO: 27293 - DNA, 336 bp, Artificial Sequence
  Description of Artificial Sequence: Synthetic polynucleotide
gatgttgtgatgactcagtctccactctccctgcccgtcacccctggagagccggcctccatctcctgctggtctagtcagagcctcctgcatagtaatggatacaactatttggattggtacctgcagaagccagggcagtctccacaggtcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcaccttcggccaagggacacgactggagattaaa

SEQ ID NO: 27294 - protein, 112 aa, Artificial Sequence
  Description of Artificial Sequence: Synthetic polypeptide
DVVMTQSPLSLPVTPGEPASISCWSSQSLLHSNGYNYLDWYLQKPGQSPQVLIYLGSNRASGVPDRFSGSGSGTDFTLKISRVEAEDVGVYYCMQALQTPLTFGQGTRLEIK

SEQ ID NO: 27295 - DNA, 321 bp, Artificial Sequence; identical to SEQ ID NO: 24295
  Description of Artificial Sequence: Synthetic polynucleotide

SEQ ID NO: 27296 - protein, 107 aa, Artificial Sequence; identical to SEQ ID NO: 24296
  Description of Artificial Sequence: Synthetic polypeptide

SEQ ID NO: 27297 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27298 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDSKRPSGIPERFSGSNSGNTATLTISGIQAMDEADYYCQAWDSSTVVFGGGTKLTVL

SEQ ID NO: 27299 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggagataaattgggggataaatatgcttcctggtatcagcagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27300 - protein, 106 aa, Artificial Sequence; identical to SEQ ID NO: 27298
  Description of Artificial Sequence: Synthetic polypeptide

SEQ ID NO: 27301 - DNA, 318 bp, Artificial Sequence; identical to SEQ ID NO: 27297
  Description of Artificial Sequence: Synthetic polynucleotide

SEQ ID NO: 27302 - protein, 106 aa, Artificial Sequence; identical to SEQ ID NO: 27298
  Description of Artificial Sequence: Synthetic polypeptide

SEQ ID NO: 27303 - DNA, 330 bp, Artificial Sequence
  Description of Artificial Sequence: Synthetic polynucleotide
cagtctgtactgactcagccaccctcaacgtctgggacccccgggcagagggtcaccatctcttgttctggaagcagctcctacatcggaagtaatactgtagactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagccttaatggcgtggtattcggcggagggaccaaactgaccgtccta

SEQ ID NO: 27304 - protein, 110 aa, Artificial Sequence
  Description of Artificial Sequence: Synthetic polypeptide
QSVLTQPPSTSGTPGQRVTISCSGSSSYIGSNTVDWYQQLPGTAPKLLIYSNNQRPSGVPDRFSGSKSGTSASLAISGLQSEDEADYYCAAWDDSLNGVVFGGGTKLTVL

SEQ ID NO: 27305 - DNA, 318 bp, Artificial Sequence
  Description of Artificial Sequence: Synthetic polynucleotide
tcctatgagttgactcagccaccctcagtgtccgtgtccccaggacagacagccagcatcacctgctctggagataaattgggggataaatttgcttgctggtatcagcagaaaccaggccagtcccctgtactggtcatctatcaagataggaagcggccctcagggatccctgagcgattctctggctccaactctgggaacacagccactctgaccatcagcgggacccaggctatggatgaggctgactattactgtcaggcgtgggacaggaacaccgctgtcttcggaactgggaccaaggtcaccgtccta

SEQ ID NO: 27306 - protein, 106 aa, Artificial Sequence
  Description of Artificial Sequence: Synthetic polypeptide
SYELTQPPSVSVSPGQTASITCSGDKLGDKFACWYQQKPGQSPVLVIYQDRKRPSGIPERFSGSNSGNTATLTISGTQAMDEADYYCQAWDRNTAVFGTGTKVTVL

SEQ ID NO: 27307 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagatagcaagcgcccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27308 - protein, 106 aa, Artificial Sequence; identical to SEQ ID NO: 27298
  Description of Artificial Sequence: Synthetic polypeptide

SEQ ID NO: 27309 - DNA, 321 bp, Artificial Sequence
  Description of Artificial Sequence: Synthetic polynucleotide
tcctatgaactgactcagccaccctcagtgtccgtgtccccaggacagacagccagtatcacctgctctggagataaattgggggataaatatgtttgctggtatcagcagaagccaggccagtcccctgagctggtcatctatcaagataggaagcggccctcagggatccctgagcgattctctggctccaactctgggaacacagccactctgaccatcagcgggacccaggctatggatgaggctgactattactgtcaggcgtggggcagtaacactgctgtggtattcggcggagggaccaagctgaccgtccta

SEQ ID NO: 27310 - protein, 107 aa, Artificial Sequence
  Description of Artificial Sequence: Synthetic polypeptide
SYELTQPPSVSVSPGQTASITCSGDKLGDKYVCWYQQKPGQSPELVIYQDRKRPSGIPERFSGSNSGNTATLTISGTQAMDEADYYCQAWGSNTAVVFGGGTKLTVL

SEQ ID NO: 27311 - DNA, 321 bp, Artificial Sequence
  Description of Artificial Sequence: Synthetic polynucleotide
tcctatgagctgactcagccgccctcagtgtccgtgtccccaggacagacagccagcatcacctgctctggagataaattgggggataaatatgtttcctggtatcagcagaggccaggccagtcccctgtgctggtcatctatcaagataggaagcggccctcagggatccctgagcgattctctggctccaactctgggaacacagccactctgaccatcagcgggaccctggctgtggatgaggctgactattactgtctggcgtgggacagcagcacttttgtggtattcggcggagggaccaagttgaccgtccta

SEQ ID NO: 27312 - protein, 107 aa, Artificial Sequence
  Description of Artificial Sequence: Synthetic polypeptide
SYELTQPPSVSVSPGQTASITCSGDKLGDKYVSWYQQRPGQSPVLVIYQDRKRPSGIPERFSGSNSGNTATLTISGTLAVDEADYYCLAWDSSTFVVFGGGTKLTVL

SEQ ID NO: 27313 - DNA, 321 bp, Artificial Sequence
  Description of Artificial Sequence: Synthetic polynucleotide
tcctatgagctgactcagccaccctcagtgtccgtgtccccaggacagacagccagcatcacctcctctggagataaattgggtaataaatatgtttgctggtatcagcagaggccaggccagtcccctgtgctggtcatctatcaagatagcaagcggccctcagggatccctgagcgattctctggctccaactccgggaacacagccactctgaccatcagcgggacccaggctatggatgaggctgactattactgtcaggcgtgggacaggaacacttatgtggtgttcggcggagggaccaagctgaccgtccta

SEQ ID NO: 27314 - protein, 107 aa, Artificial Sequence
  Description of Artificial Sequence: Synthetic polypeptide
SYELTQPPSVSVSPGQTASITSSGDKLGNKYVCWYQQRPGQSPVLVIYQDSKRPSGIPERFSGSNSGNTATLTISGTQAMDEADYYCQAWDRNTYVVFGGGTKLTVL

SEQ ID NO: 27315 - DNA, 318 bp, Artificial Sequence
  Description of Artificial Sequence: Synthetic polynucleotide
tcctatgagctgactcagccaccctcagtgtccgtgtccccaggacagacagccagcatcacctgttctggagatgaattggggaataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtggcacagcagcactgtggtattcggcggagggaccaagctgaccgtccta

SEQ ID NO: 27316 - protein, 106 aa, Artificial Sequence
  Description of Artificial Sequence: Synthetic polypeptide
SYELTQPPSVSVSPGQTASITCSGDELGNKYACWYQQKPGQSPVLVIYQDSKRPSGIPERFSGSNSGNTATLTISGTQAMDEADYYCQAWHSSTVVFGGGTKLTVL

SEQ ID NO: 27317 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataggaagcggccctcagggatccctgagcgattctctggctccaactctgggaacacagccactctgaccattagcgggacccaggctatggatgaggctgactattactgtcaggcgtggcacagcagtactgtggtattcggcggagggaccaagctgaccgtccta

SEQ ID NO: 27318 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDRKRPSGIPERFSGSNSGNTATLTISGTQAMDEADYYCQAWHSSTVVFGGGTKLTVL

SEQ ID NO: 27319 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgttggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27320 - protein, 106 aa, Artificial Sequence; identical to SEQ ID NO: 27298
  Description of Artificial Sequence: Synthetic polypeptide

SEQ ID NO: 27321 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagatagcaagcggccctcagggatccctgagcgattctctggctccaactctgggaacgcagccactctgaccatcagcgggatccaggctatggatgaggctgactattactgtcaggcgtgggacagcagcactgtggtattcggcggagggaccaagctgaccgtccta

SEQ ID NO: 27322 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDSKRPSGIPERFSGSNSGNAATLTISGIQAMDEADYYCQAWDSSTVVFGGGTKLTVL

SEQ ID NO: 27323 - DNA, 330 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagttatgctgtaaactggtatcagcagctcccaggaacggcccccaaactcctcatttatagtaataatcaccggccctcaggggtccctgaccgattctctggctccaagtctggcacctcagcctccctggccatcagtgggctccagtctgaggatgaggctgattattactgtgaagcatgggatgacagcctgaatggtccggtattcggcggagggaccaagctgaccgtccta

SEQ ID NO: 27324 - protein, 110 aa, Artificial Sequence
  Description of Artificial Sequence: Synthetic polypeptide
QSVLTQPPSASGTPGQRVTISCSGSSSNIGSYAVNWYQQLPGTAPKLLIYSNNHRPSGVPDRFSGSKSGTSASLAISGLQSEDEADYYCEAWDDSLNGPVFGGGTKLTVL

SEQ ID NO: 27325 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaattctataaactggtaccagcaactcccaagaacggcccccaaactcctcatctatagtaatgatcagcggccctcaggggtccctgaccgattctctggctccaagtctggcacctcagcctccctggccatcagtgggctccagtctgaggatgaggctgattattactgtgcagcatgggatgacagcctgaacggcgtggtattcggcggagggaccaagctgaccgtccta

SEQ ID NO: 27326 - protein, 110 aa, Artificial Sequence
  Description of Artificial Sequence: Synthetic polypeptide
QSVLTQPPSASGTPGQRVTISCSGSSSNIGSNSINWYQQLPRTAPKLLIYSNDQRPSGVPDRFSGSKSGTSASLAISGLQSEDEADYYCAAWDDSLNGVVFGGGTKLTVL

SEQ ID NO: 27327 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatgctgtaaactggtaccagcagctcccaggaacggcccccaaactcctcatctatagtaataatcagcggccctcaggggtccctgaccggttctctggctccaagtctggcacctcagcctccctggccatcagtgggctccagtctgaggatgaggctgattattactgtgcagcatgggatgacagcctgaatggcgtggtattcggcggagggaccaagctgaccgtccta

SEQ ID NO: 27328 - protein, 110 aa, Artificial Sequence
  Description of Artificial Sequence: Synthetic polypeptide
QSVLTQPPSASGTPGQRVTISCSGSSSNIGSNAVNWYQQLPGTAPKLLIYSNNQRPSGVPDRFSGSKSGTSASLAISGLQSEDEADYYCAAWDDSLNGVVFGGGTKLTVL

SEQ ID NO: 27329 - DNA, 318 bp, Artificial Sequence; identical to SEQ ID NO: 27297
  Description of Artificial Sequence: Synthetic polynucleotide

SEQ ID NO: 27330 - protein, 106 aa, Artificial Sequence; identical to SEQ ID NO: 27298
  Description of Artificial Sequence: Synthetic polypeptide

SEQ ID NO: 27331 - DNA, 321 bp, Artificial Sequence
  Description of Artificial Sequence: Synthetic polynucleotide
tcctatgagctgactcagccgccctcagtgtccgtgtccccaggacagacagccagcatcacctgctctggagataaattgggggataaatatgtttcctggtatcagcagaagccaggccagtcccctatactggtcatctatcaagataggaagcggccctcagggacccctgagcgattctctggctccaactctgggaacacagccactctgaccatcagcgggacccaggctatggatgaggctgattattactgtctggcgtgggacagcagcacttttgtggtattcggcggagggaccaagttgaccgtccta

SEQ ID NO: 27332 - protein, 107 aa, Artificial Sequence
  Description of Artificial Sequence: Synthetic polypeptide
SYELTQPPSVSVSPGQTASITCSGDKLGDKYVSWYQQKPGQSPILVIYQDRKRPSGTPERFSGSNSGNTATLTISGTQAMDEADYYCLAWDSSTFVVFGGGTKLTVL

SEQ ID NO: 27333 - DNA, 318 bp, Artificial Sequence
  Description of Artificial Sequence: Synthetic polynucleotide
tcctatgagctgactcagccaccctcagtgtccgtgtccccaggacagacagccagcatcacctgttctggagataaattggggaataaatatgtttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtggcacagcagcactgtggtattcggcggagggaccaagctgaccgtccta

SEQ ID NO: 27334 - protein, 106 aa, Artificial Sequence
  Description of Artificial Sequence: Synthetic polypeptide
SYELTQPPSVSVSPGQTASITCSGDKLGNKYVCWYQQKPGQSPVLVIYQDSKRPSGIPERFSGSNSGNTATLTISGTQAMDEADYYCQAWHSSTVVFGGGTKLTVL

SEQ ID NO: 27335 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatttgcttcctggtatcagcagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27336 - protein, 106 aa, Artificial Sequence
  Description of Artificial Sequence: Synthetic polypeptide
SYELTQPPSVSVSPGQTASITCSGDKLGDKFASWYQQKPGQSPVLVIYQDSKRPSGIPERFSGSNSGNTATLTISGIQAMDEADYYCQAWDSSTVVFGGGTKLTVL

SEQ ID NO: 27337 - DNA, 330 bp, Artificial Sequence; identical to SEQ ID NO: 27327
  Description of Artificial Sequence: Synthetic polynucleotide

SEQ ID NO: 27338 - protein, 110 aa, Artificial Sequence; identical to SEQ ID NO: 27328
  Description of Artificial Sequence: Synthetic polypeptide

SEQ ID NO: 27339 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggatataaattggggtataaatatgtttgctggtatcagcagaagccaggccagtcccctgtactggtcatctttcaaaataaccagcggccctcagggatccctgagcgattctctggctccaactctgggaacacagcctctctgaccatcagcgggacccaggctatggatgaggctgactattactgtcaggcgtgggacagcagcactgtggtattcggcggagggaccaagctgaccgtccta

SEQ ID NO: 27340 - protein, 106 aa, Artificial Sequence
  Description of Artificial Sequence: Synthetic polypeptide
SYELTQPPSVSVSPGQTASITCSGYKLGYKYVCWYQQKPGQSPVLVIFQNNQRPSGIPERFSGSNSGNTASLTISGTQAMDEADYYCQAWDSSTVVFGGGTKLTVL

SEQ ID NO: 27341 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggaaataaattgggggataaatatgcttcctggtatcagcagaagccaggccagtcccctgtgctggtcatctatcaagatagcaagcggccctcagggatccctgagcgattctctggctccaagtctgggaacacagccactctgaccatcagcgggatccaggctatggatgaggctgactattactgtcaggcgtgggacagcagcactgtggtattcggcggagggaccaagctgaccgtccca

SEQ ID NO: 27342 - protein, 106 aa, Artificial Sequence
  Description of Artificial Sequence: Synthetic polypeptide
SYELTQPPSVSVSPGQTASITCSGNKLGDKYASWYQQKPGQSPVLVIYQDSKRPSGIPERFSGSKSGNTATLTISGIQAMDEADYYCQAWDSSTVVFGGGTKLTVP

SEQ ID NO: 27343 - DNA, 345 bp, Artificial Sequence
  Description of Artificial Sequence: Synthetic polynucleotide
caggctgtgtcgactcagccgtcttccctctctgcatctcctggagcatcagccagtctcacctgcaccttacgcagtggcatcactgttactacctataggatatactggtaccagcagaagccagggagtcctccccagtttctcctgcggtacacatcagactcagataaacaccagggctctggagtccccagccgcttctctggatccaaagatgcttcggccaatgcagggattttattcatctctgggctccagtctgaggatgaggctgactattactgtatgatttggcacagcagcgcttgggtgttcggcggagggaccaagctgaccgtccta

SEQ ID NO: 27344 - protein, 115 aa, Artificial Sequence
  Description of Artificial Sequence: Synthetic polypeptide
QAVSTQPSSLSASPGASASLTCTLRSGITVTTYRIYWYQQKPGSPPQFLLRYTSDSDKHQGSGVPSRFSGSKDASANAGILFISGLQSEDEADYYCMIWHSSAWVFGGGTKLTVL

SEQ ID NO: 27345 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagataacaagcggccctcagggatccctgagcgattctctggctccaactctgggaacacagccactctgaccatcggcgggatccaggctatggatgaggctgactattactgtcaggcgtgggacagcagcactgtggtattcggcggagggaccaagctgaccgtccta

SEQ ID NO: 27346 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDNKRPSGIPERFSGSNSGNTATLTIGGIQAMDEADYYCQAWDSSTVVFGGGTKLTVL

SEQ ID NO: 27347 - DNA, 321 bp, Artificial Sequence
  Description of Artificial Sequence: Synthetic polynucleotide
tcctatgaactgactcagccgccctcagtgtccgtgtccccaggacagacagccagcatcacctgctctggagataaattggggaataaatatgtttcctggtatcagcagaagccaggccagtcccctgtgctggtcatctatcaagatagcaggcggccctcagggatccctgagcgattctctggctccaactctgggaacacagccactctgaccatcagcgggacccaggctatggatgaggctgactattactgtctggcgtgggacagcagcacttttgtggtcttcggcggagggaccaagttgaccgtccta

SEQ ID NO: 27348 - protein, 107 aa, Artificial Sequence
  Description of Artificial Sequence: Synthetic polypeptide
SYELTQPPSVSVSPGQTASITCSGDKLGNKYVSWYQQKPGQSPVLVIYQDSRRPSGIPERFSGSNSGNTATLTISGTQAMDEADYYCLAWDSSTFVVFGGGTKLTVL

SEQ ID NO: 27349 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagatgaattggggaataaatatgcttgctggtatcagcagaagccaggccagtcccctgtgctggtcatctatcaagataacaagcggccctcagggatccctgagcgattctctggctccagctctgggaacacagccactctgaccatcagcgggacccaggctatggatgaggctgactattactgtcaggcgtggcacagcagcactgtggtattcggcggagggaccaagctgaccgtccta

SEQ ID NO: 27350 - protein, 106 aa, Artificial Sequence
  Description of Artificial Sequence: Synthetic polypeptide
SYELTQPPSVSVSPGQTASITCSGDELGNKYACWYQQKPGQSPVLVIYQDNKRPSGIPERFSGSSSGNTATLTISGTQAMDEADYYCQAWHSSTVVFGGGTKLTVL

SEQ ID NO: 27351 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctgtcaagatagcaagcggccctcagggatccctgagcgattctctggctccaactctgggaacacagccactctgaccatcagcgggatccaggctatggatgaggctgactattgctgtcaggcgtgggacagcagcactgtggtattcggcggagggaccaagctgaccgtccta

SEQ ID NO: 27352 - protein, 106 aa, Artificial Sequence
  Description of Artificial Sequence: Synthetic polypeptide
SYELTQPPSVSVSPGQTASITCSGDKLGDKYASWYQQKPGQSPVLVICQDSKRPSGIPERFSGSNSGNTATLTISGIQAMDEADYCCQAWDSSTVVFGGGTKLTVL

SEQ ID NO: 27353 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatgctgtaaactggtaccagcagctcccaggaacggcccccaaactcctcatctatagtaatagtcagcggccctcaggggtccctgaccggttctctggctccaagtctggcacctcagcctccctggccatcagtgggctccagtctgaggatgaggctgattatttctgtgcagcatgggatgacagcctgaatggcgtggtattcggcggagggaccaagctgaccgtccta

SEQ ID NO: 27354 - protein, 110 aa, Artificial Sequence
  Description of Artificial Sequence: Synthetic polypeptide
QSVLTQPPSASGTPGQRVTISCSGSSSNIGSNAVNWYQQLPGTAPKLLIYSNSQRPSGVPDRFSGSKSGTSASLAISGLQSEDEADYFCAAWDDSLNGVVFGGGTKLTVL

SEQ ID NO: 27355 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagatagcaagcggccctcagggatccctgagcgattctctggctccaactctgggaacacagccactctgaccatcagcgggatccaggctatggatgaggctgacttttactgtcaggcgtgggacagcagcactgtggtattcggcggagggaccaagctgaccgtccta

SEQ ID NO: 27356 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDSKRPSGIPERFSGSNSGNTATLTISGIQAMDEADFYCQAWDSSTVVFGGGTKLTVL

SEQ ID NO: 27357 - DNA, 318 bp, Artificial Sequence
  Description of Artificial Sequence: Synthetic polynucleotide
tcttatgagctgactcagccaccctcagtgtccgtgtccccaggacagacagccagcatcacctgctctggagataaattgggggataaatatgtttgctggtatcagcagaagccaggccagtcccctgtgctggtcatctatcaagatcgcaagcggccctcagggatccctgagcgattctctggctccaactctgggaacacagccactctgaccatcagcgggacccaggctatggatgaggctgactattactgtcaggcgtggcacagcagcactgtggtattcggcggagggaccaagctgaccgtccta

SEQ ID NO: 27358 - protein, 106 aa, Artificial Sequence
  Description of Artificial Sequence: Synthetic polypeptide
SYELTQPPSVSVSPGQTASITCSGDKLGDKYVCWYQQKPGQSPVLVIYQDRKRPSGIPERFSGSNSGNTATLTISGTQAMDEADYYCQAWHSSTVVFGGGTKLTVL

SEQ ID NO: 27359 - DNA, 318 bp, Artificial Sequence
  Description of Artificial Sequence: Synthetic polynucleotide
tcctatgagctgactcagccaccctcagtgtccgtgtccccaggacagacagccagcatcgcctgctctggagataaattgggggataaatatgcttcctggtatcaacagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27360 - protein, 106 aa, Artificial Sequence
  Description of Artificial Sequence: Synthetic polypeptide
SYELTQPPSVSVSPGQTASIACSGDKLGDKYASWYQQKPGQSPVLVIYQDSKRPSGIPERFSGSNSGNTATLTISGIQAMDEADYYCQAWDSSTVVFGGGTKLTVL

SEQ ID NO: 27361 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctatggatgaggctgactattactgtcaggcgtgggacagcagcacttatgtcttcggaactgggaccaaggtcaccgtccta

SEQ ID NO: 27362 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDTKRPSGIPERFSGSNSGNTATLTISGTQAMDEADYYCQAWDSSTYVFGTGTKVTVL

SEQ ID NO: 27363 - DNA, 318 bp, Artificial Sequence
  Description of Artificial Sequence: Synthetic polynucleotide
tcctatgacctgactcagccaccctcagtgtccgtgtccccaggacagacagccagcatcacctgctctggagataaattgggggataaatatgcttcctggtatcagcagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27364 - protein, 106 aa, Artificial Sequence
  Description of Artificial Sequence: Synthetic polypeptide
SYDLTQPPSVSVSPGQTASITCSGDKLGDKYASWYQQKPGQSPVLVIYQDSKRPSGIPERFSGSNSGNTATLTISGIQAMDEADYYCQAWDSSTVVFGGGTKLTVL

SEQ ID NO: 27365 - DNA, 318 bp, Artificial Sequence
  Description of Artificial Sequence: Synthetic polynucleotide
tcctatgagctgactcagccaccctcagtgtccgtgtccccaggacagacagccagcatcgcctgctctggagataatttgggggataaatatgcttcctggtatcaacagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27366 - protein, 106 aa, Artificial Sequence
  Description of Artificial Sequence: Synthetic polypeptide
SYELTQPPSVSVSPGQTASIACSGDNLGDKYASWYQQKPGQSPVLVIYQDSKRPSGIPERFSGSNSGNTATLTISGIQAMDEADYYCQAWDSSTVVFGGGTKLTVL

SEQ ID NO: 27367 - DNA, 318 bp, Artificial Sequence
  Description of Artificial Sequence: Synthetic polynucleotide
tcctatgagatgactcagccaccctcagtgtccgtgtccccaggacagacagccatcatcacctgctctggagataaattgggggataaatatgcttgctggtatcaacagaagccaggccagtcccctgtgctggtcatctatcaagattccaagcggccctcagggatccctgagcgattctctggctccaactctgggaacacagccactctgaccatcagcgggacccaggctatggatgaggctgactattactgtcaggcgtgggacagcagcacttatgtcttcggaactgggaccaaggtcaccgtccta

SEQ ID NO: 27368 - protein, 106 aa, Artificial Sequence
  Description of Artificial Sequence: Synthetic polypeptide
SYEMTQPPSVSVSPGQTAIITCSGDKLGDKYACWYQQKPGQSPVLVIYQDSKRPSGIPERFSGSNSGNTATLTISGTQAMDEADYYCQAWDSSTYVFGTGTKVTVL

SEQ ID NO: 27369 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagatagcaagcggccctcagggatccctgagcgattctctggctccaactctgggaacacagccactctgaccatcagcgggatccaggctctggatgaggctgactattactgtcaggcgtgggacaacagcactgtggtattcggcggagggaccaagctgaccgtccta

SEQ ID NO: 27370 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDSKRPSGIPERFSGSNSGNTATLTISGIQALDEADYYCQAWDNSTVVFGGGTKLTVL

SEQ ID NO: 27371 - DNA, 318 bp, Artificial Sequence; identical to SEQ ID NO: 27297
  Description of Artificial Sequence: Synthetic polynucleotide

SEQ ID NO: 27372 - protein, 106 aa, Artificial Sequence; identical to SEQ ID NO: 27298
  Description of Artificial Sequence: Synthetic polypeptide

SEQ ID NO: 27373 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggcgataaattgggaaataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctatggatgaggctgactattactgtcaggcgtgggacagcagcacttatgtcttcggaactgggaccaaggtcaccgtccta

SEQ ID NO: 27374 - protein, 106 aa, Artificial Sequence
  Description of Artificial Sequence: Synthetic polypeptide
SYELTQPPSVSVSPGQTASITCSGDKLGNKYACWYQQKPGQSPVLVIYQDTKRPSGIPERFSGSNSGNTATLTISGTQAMDEADYYCQAWDSSTYVFGTGTKVTVL

SEQ ID NO: 27375 - DNA, 318 bp, Artificial Sequence
  Description of Artificial Sequence: Synthetic polynucleotide
tcctatgagctgactcagccaccctcagtgtccgtgtccccagggcagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctatggatgaggctgactattactgtcaggcgtgggacagcagcacttatgtcttcggaactgggaccaaggtcaccgtccta

SEQ ID NO: 27376 - protein, 106 aa, Artificial Sequence; identical to SEQ ID NO: 27362
  Description of Artificial Sequence: Synthetic polypeptide

SEQ ID NO: 27377 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggaagtaaattgggtaataaatatgtttgctggtatcagcagaggccaggccagtcccctgtactggtcatctatcaagataacaagcggccctcagggatccctgagcgattctctggctccaactccggaaacacagccactctgaccatcagcgggacccaggctatggatgaggctggctattactgtcaggcgtgggacagcagcacttatgtgatattcggcggagggaccaagctgaccgtccta

SEQ ID NO: 27378 - protein, 107 aa, Artificial Sequence
  Description of Artificial Sequence: Synthetic polypeptide
SYELTQPPSVSVSPGQTASITCSGSKLGNKYVCWYQQRPGQSPVLVIYQDNKRPSGIPERFSGSNSGNTATLTISGTQAMDEAGYYCQAWDSSTYVIFGGGTKLTVL

SEQ ID NO: 27379 - DNA, 318 bp, Artificial Sequence
  Description of Artificial Sequence: Synthetic polynucleotide
tcctatgagctgactcagccaccctcagtgtccgtgtccccaggacagacagcgagcatcacctgctctggagataaattgggggataaatatgcttgctggtatcagcagaagccaggccagtcccctgtactggtcatctatcaagataggaagcggccctcagggatccctgagcgattctctggctccaactctgggaacacagccactctgaccatcagcgggacccaggctatggatgaggctgactattactgtcaggcgtggcacagcagtactgtggtattcggcggagggaccaaggtgaccgtccta

SEQ ID NO: 27380 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDRKRPSGIPERFSGSNSGNTATLTISGTQAMDEADYYCQAWHSSTVVFGGGTKVTVL

SEQ ID NO: 27381 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttgctggtatcagcagaagccaggccagtcccctgtgttggtcatctatcaagataggaagcggccctcagggatccctgagcgattctctggctccaactctgggaacacagccactctgaccatcaccgggacccaggctatggatgaggctgactattactgtcaggcgtggcacagcagcactgtggtattcggcggagggaccaagctgaccgtccta

SEQ ID NO: 27382 - protein, 106 aa, Artificial Sequence
  Description of Artificial Sequence: Synthetic polypeptide
SYELTQPPSVSVSPGQTASITCSGDKLGDKYVCWYQQKPGQSPVLVIYQDRKRPSGIPERFSGSNSGNTATLTITGTQAMDEADYYCQAWHSSTVVFGGGTKLTVL

SEQ ID NO: 27383 - DNA, 318 bp, Artificial Sequence
  Description of Artificial Sequence: Synthetic polynucleotide
tcctatgagctgactcagccaccctcagtgtccgtgtccccaggacagacagccagaatcacctgctctggagataaattgggggataaatatgcttcctggtatcagcagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27384 - protein, 106 aa, Artificial Sequence
  Description of Artificial Sequence: Synthetic polypeptide
SYELTQPPSVSVSPGQTARITCSGDKLGDKYASWYQQKPGQSPVLVIYQDSKRPSGIPERFSGSNSGNTATLTISGIQAMDEADYYCQAWDSSTVVFGGGTKLTVL

SEQ ID NO: 27385 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggaaataaatatgtttgttggtatcagcagaagccaggccagtcccctgtggaagtcatctataaagatagtaagcggccctcagggatccctgagcgattctctggctccaattctgggaacacaggcactctgaccatcagcgggacccaggctatggatgaggctgactattactgtcaggcgtgggacaacagtactttagtattcggcggagggaccaagctgaccgtccta

SEQ ID NO: 27386 - protein, 106 aa, Artificial Sequence
  Description of Artificial Sequence: Synthetic polypeptide
SYELTQPPSVSVSPGQTASITCSGDKLGNKYVCWYQQKPGQSPVEVIYKDSKRPSGIPERFSGSNSGNTGTLTISGTQAMDEADYYCQAWDNSTLVFGGGTKLTVL

SEQ ID NO: 27387 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggtcagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacaacagcactgtggtattcggcggagggaccaagctgaccgtccta

SEQ ID NO: 27388 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDSKRPSGIPERFSGSNSGNTATLTISGIQAMDEADYYCQAWDNSTVVFGGGTKLTVL

SEQ ID NO: 27389 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataagaagcggccctcagggatccctgagcgattctctggctccaactctgggaacatagccactctgaccatcagcgggacccaggctatggatgaggctgactattactgtcaggcgtggcacagcagtattgtggtattcggcggagggaccaagctgaccgtccta

SEQ ID NO: 27390 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDKKRPSGIPERFSGSNSGNIATLTISGTQAMDEADYYCQAWHSSIVVFGGGTKLTVL

SEQ ID NO: 27391 - DNA, 330 bp, Artificial Sequence
  Description of Artificial Sequence: Synthetic polynucleotide
cagtctgtactgactcagccaccctcagcgtctgggacccccgggcagagggtcaccatctcttgttctggaagcagctccaacatcggaaataatgctgtaagctggtatcagcagctcccaggaacggcccccaaactcctcatctatagtaatgatcaccggccctcaggggtccctgaccgattctctggctccaagtctggcacctcagcctccctggccatcagtgggctccagtctgaggatgaggctgattattactgtgcagcatgggatgacagcctgaagggtccggtattcggcggagggaccaagctgaccgtccta

SEQ ID NO: 27392 - protein, 110 aa, Artificial Sequence
  Description of Artificial Sequence: Synthetic polypeptide
QSVLTQPPSASGTPGQRVTISCSGSSSNIGNNAVSWYQQLPGTAPKLLIYSNDHRPSGVPDRFSGSKSGTSASLAISGLQSEDEADYYCAAWDDSLKGPVFGGGTKLTVL

SEQ ID NO: 27393 - DNA, 336 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaatatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactggcctccaggctgaggatgaggctgattatcactgccagtcctatgacagcagcctgagtggtcctgtgatattcggcggagggaccaagctgaccgtccta

SEQ ID NO: 27394 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYHCQSYDSSLSGPVIFGGGTKLTVL

SEQ ID NO: 27395 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataagttgggggataaatatgtttgctggtatcagcagaagccaggccagtcccctatgttggtcatctatcaagatagtaagcggccctcagggatccctgagcgattctctggctccaactctgggaacacagccactctgaccatcagcgggacccaggctatggatgaggctgactattactgtcaggcgtgggacaatagtatttatgtcttcggaactgggaccaaggtcaccgtccta

SEQ ID NO: 27396 - protein, 106 aa, Artificial Sequence
  Description of Artificial Sequence: Synthetic polypeptide
SYELTQPPSVSVSPGQTASITCSGDKLGDKYVCWYQQKPGQSPMLVIYQDSKRPSGIPERFSGSNSGNTATLTISGTQAMDEADYYCQAWDNSIYVFGTGTKVTVL

SEQ ID NO: 27397 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttgctggtatcagcagaagccaggccagtcccctgtgctggtcatctttcaagatagaaagcggccctcagggatccctgagcgattctctggctccaactctgggaacacagccactctgaccatcagcgggacccaggctatggatgaggctgactattactgtcaggcgtgggacagcagcactgtggtgttcggcggagggaccaaagttaccgtccta

SEQ ID NO: 27398 - protein, 106 aa, Artificial Sequence
  Description of Artificial Sequence: Synthetic polypeptide
SYELTQPPSVSVSPGQTASITCSGDKLGDKYVCWYQQKPGQSPVLVIFQDRKRPSGIPERFSGSNSGNTATLTISGTQAMDEADYYCQAWDSSTVVFGGGTKVTVL

SEQ ID NO: 27399 - DNA, 318 bp, Artificial Sequence
  Description of Artificial Sequence: Synthetic polynucleotide
tcctatgagctgactcagccaccctcagtgtccgtgtccccaggacagacagtcagcatcacctgctctggagataaattgggggataaatatgtttcctggtatcagcagaagccaggccagtcccctgtgctggtcatctatcaagatagcaagcggccctcagggatccctgagcgattctctggctccaactctgggaacacagccactctgaccatcagcgggatccaggctatggatgaggctgactattactgtcaggcgtgggacagcagcactgtggtattcggcggagggaccaagctgaccgtccta

SEQ ID NO: 27400 - protein, 106 aa, Artificial Sequence
  Description of Artificial Sequence: Synthetic polypeptide
SYELTQPPSVSVSPGQTVSITCSGDKLGDKYVSWYQQKPGQSPVLVIYQDSKRPSGIPERFSGSNSGNTATLTISGIQAMDEADYYCQAWDSSTVVFGGGTKLTVL

SEQ ID NO: 27401 - DNA, 321 bp, Artificial Sequence
  Description of Artificial Sequence: Synthetic polynucleotide
tcctatgagctgactcagccgccctcagtgtccgtgtccccaggacagacagccagcatcacctgctctggagataaattgggggataaatatgtttcctggtatcagcagaagccaggccagtcccctgtgctggtcatctatcaagataggaagcggccctcagggacccctgagcgattctctggctccaactctgggaacacagccactctgaccatcagcgggacccaggctatggatgaggctgactattactgtctggcgtgggacagcagcacttttgtggtattcggcggagggaccaagttgaccgtccta

SEQ ID NO: 27402 - protein, 107 aa, Artificial Sequence
  Description of Artificial Sequence: Synthetic polypeptide
SYELTQPPSVSVSPGQTASITCSGDKLGDKYVSWYQQKPGQSPVLVIYQDRKRPSGTPERFSGSNSGNTATLTISGTQAMDEADYYCLAWDSSTFVVFGGGTKLTVL

SEQ ID NO: 27403 - DNA, 330 bp, Artificial Sequence
  Description of Artificial Sequence: Synthetic polynucleotide
cagtctgtggtgactcagccaccctcagcgtctgggacccccgggcagagggtcaccatctcttgttctggaagcagctccaacatcggaagtaatactgtaaattggtaccagcagctcccaggaacggcccccaaactcctcatctatagtagtaatcagcggccctcaggggtccctgaccgattgtctggctccaagtctggcacctcagcctccctggccatcagtgggctccagtctgaggatgaggctgattattactgtgcagcatgggatgacagcctgaatggcgtggtattcggcggagggaccaaggtgaccgtccta

SEQ ID NO: 27404 - protein, 110 aa, Artificial Sequence
  Description of Artificial Sequence: Synthetic polypeptide
QSVVTQPPSASGTPGQRVTISCSGSSSNIGSNTVNWYQQLPGTAPKLLIYSSNQRPSGVPDRLSGSKSGTSASLAISGLQSEDEADYYCAAWDDSLNGVVFGGGTKVTVL

SEQ ID NO: 27405 - DNA, 321 bp, Artificial Sequence
  Description of Artificial Sequence: Synthetic polynucleotide
tcctatgacctgactcagccaccctcagtgtccgtgtccccaggacagacagccagcatcacctgctctggagataaattgggggataaatatgtttgctggtatcagcagaagccaggccagtcccctgtgctggtcatctatcaagatagtaagcggccctcagggatccctgagcgattctctggctccaactctgggaacacagccactctgaccatcaccgggacccaggctatggatgaggctaactattactgtcaggcgtgggacaacagcagctttgtgctattcggcggagggaccaagctgaccgtccta

SEQ ID NO: 27406 - protein, 107 aa, Artificial Sequence
  Description of Artificial Sequence: Synthetic polypeptide
SYDLTQPPSVSVSPGQTASITCSGDKLGDKYVCWYQQKPGQSPVLVIYQDSKRPSGIPERFSGSNSGNTATLTITGTQAMDEANYYCQAWDNSSFVLFGGGTKLTVL

SEQ ID NO: 27407 - DNA, 321 bp, Artificial Sequence
  Description of Artificial Sequence: Synthetic polynucleotide
tcctatgagctgactcagccaccctcagtgaccgtgtccccaggacagacagccagcatcacctgctctggagataaattgggggataaatatgtttgctggtatcagcagaagccaggccagtcccctgtgctggtcatctatcaagatcgcaagcggccctcagggatccctgagcgattgtctggctccaactctgggaacacagccactctgaccatcagcgggacccaggctctggatgaggctgactattactgtcaggcgtggggcaacagcagctttgtggtattcggcggagggaccaagctgaccgtccta

SEQ ID NO: 27408 - protein, 107 aa, Artificial Sequence
  Description of Artificial Sequence: Synthetic polypeptide
SYELTQPPSVTVSPGQTASITCSGDKLGDKYVCWYQQKPGQSPVLVIYQDRKRPSGIPERLSGSNSGNTATLTISGTQALDEADYYCQAWGNSSFVVFGGGTKLTVL

SEQ ID NO: 27409 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttgctggtatcagcagaagccaggccagtcccctgtgttggtcatctatcaagataggaagcggccctcagggatccctgagcgattctctggctccaactctgggaacacagccactctgaccatcagcgggacccaggctctggatgaggctgactattactgtcaggcgtggggcaacagcagctttgtggtattcggcggagggaccaagctgaccgtccta

SEQ ID NO: 27410 - protein, 107 aa, Artificial Sequence
  Description of Artificial Sequence: Synthetic polypeptide
SYELTQPPSVSVSPGQTASITCSGDKLGDKYVCWYQQKPGQSPVLVIYQDRKRPSGIPERFSGSNSGNTATLTISGTQALDEADYYCQAWGNSSFVVFGGGTKLTVL

SEQ ID NO: 27411 - DNA, 321 bp, Artificial Sequence
  Description of Artificial Sequence: Synthetic polynucleotide
tccgatgagctgactcagtcaccctcagtgtccgtgtccccaggacagacagccagcatcacctgctctggagataaattgggggataaatatgtttgctggtatcagcagaagccaggccagtcccctgtgttggtcatctatcaagatagcaagcggccctcagggatccctgagcgattctctggctccaactctgggaacacagccactctgaccatcagcgggacccaggctctggatgaggctgactattactgtcaggcgtggggcaacagcagctttgtggtattcggcggagggaccaagctgaccgtccta

SEQ ID NO: 27412 - protein, 107 aa, Artificial Sequence
  Description of Artificial Sequence: Synthetic polypeptide
SDELTQSPSVSVSPGQTASITCSGDKLGDKYVCWYQQKPGQSPVLVIYQDSKRPSGIPERFSGSNSGNTATLTISGTQALDEADYYCQAWGNSSFVVFGGGTKLTVL

SEQ ID NO: 27413 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagatagattgggggataaatatgtttgctggtatcagcagaagccaggccagtcccctgtactggtcatctttcaagataacaagcggccctcagggatccctgagcgattctctggctccaactctgggaacacagccactctgaccatcagcgggacccaggctctggatgaggctgactattactgtcaggcgtgggtcaacaacactgcagtggttttcggcggagggaccaagctgaccgtccta

SEQ ID NO: 27414 - protein, 107 aa, Artificial Sequence
  Description of Artificial Sequence: Synthetic polypeptide
SYELTQPPSVSVSPGQTASITCSGDRLGDKYVCWYQQKPGQSPVLVIFQDNKRPSGIPERFSGSNSGNTATLTISGTQALDEADYYCQAWVNNTAVVFGGGTKLTVL

SEQ ID NO: 27415 - DNA, 321 bp, Artificial Sequence
  Description of Artificial Sequence: Synthetic polynucleotide
tcctttgacctgactcagccaccctcagtgtccgtgtccccaggacagacagccagcatcacctgctctggagataaattgggggataaatatgtttgctggtatcagcagaagccaggccagtcccctgtgctggtcatctatcaagatagcaagcggccctcagggatccctgagcgaatctctggctccaactctgggaacacagccactctgaccatcagcgggacccaggctatggatgaggctgactattactgtcagacgtgggacaacagtagttttgcgcttttcggcggagggaccaagctgaccgtccta

SEQ ID NO: 27416 - protein, 107 aa, Artificial Sequence
  Description of Artificial Sequence: Synthetic polypeptide
SFDLTQPPSVSVSPGQTASITCSGDKLGDKYVCWYQQKPGQSPVLVIYQDSKRPSGIPERISGSNSGNTATLTISGTQAMDEADYYCQTWDNSSFALFGGGTKLTVL

SEQ ID NO: 27417 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggtgataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctatggatgaggctgactattactgtcaggcgtgggacagcaccactctggttttcggcggagggaccaagctgaccgtccta

SEQ ID NO: 27418 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDTKRPSGIPERFSGSNSGNTATLTISGTQAMDEADYYCQAWDSTTLVFGGGTKLTVL

SEQ ID NO: 27419 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggtgataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcaccactctggttttcggcggagggaccaagctgaccgtccta

SEQ ID NO: 27420 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSTTLVFGGGTKLTVL

SEQ ID NO: 27421 - DNA, 318 bp, Artificial Sequence
  Description of Artificial Sequence: Synthetic polynucleotide
tcctatgagctgagtcagccaccctcagtgtccgtgtccccaggacagacagccagcatcacctgctctggagataaattgggggataaatatgttcactggtatcagcagaagccaggccagtcccctgtgttggtcatctatcaagatagcaagcggccctcagggatccctgagcgattctctggctccaactctgggaacacagccactctgaccatcagcgggacccaggctatggatgaggctgattattactgtcaggcgtgggacaacagcactgcggtattcggcggagggaccaagttgaccgtccta

SEQ ID NO: 27422 - protein, 106 aa, Artificial Sequence
  Description of Artificial Sequence: Synthetic polypeptide
SYELSQPPSVSVSPGQTASITCSGDKLGDKYVHWYQQKPGQSPVLVIYQDSKRPSGIPERFSGSNSGNTATLTISGTQAMDEADYYCQAWDNSTAVFGGGTKLTVL

SEQ ID NO: 27423 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttgttggtatcagcagaagccaggccagtcccctttgctggtcatctataaagatatcaagcggccctcagggatccctgagcgattctctggctccaactctggtaacacagccactctgaccatcagcgggacccaggctatggatgaggctgactattactgtcaggcgtgggacaccaacactgtgatattcggcggagggaccaagctgaccgtccta

SEQ ID NO: 27424 - protein, 106 aa, Artificial Sequence
  Description of Artificial Sequence: Synthetic polypeptide
SYELTQPPSVSVSPGQTASITCSGDKLGDKYVCWYQQKPGQSPLLVIYKDIKRPSGIPERFSGSNSGNTATLTISGTQAMDEADYYCQAWDTNTVIFGGGTKLTVL

SEQ ID NO: 27425 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttgttggtatcagcggaagccaggccagtcccctgttctggtcatctatcaggattacaagcggccctcagggatccctgagcgattctctggctccaactctgggaacacagccactctgaccatcagcgggacccaggctatggatgaggctgactattactgtcaggcgtgggacaccaacactgtgcttttcggcggagggaccaagctgaccgtcctg

SEQ ID NO: 27426 - protein, 106 aa, Artificial Sequence
  Description of Artificial Sequence: Synthetic polypeptide
SYELTQPPSVSVSPGQTASITCSGDKLGDKYVCWYQRKPGQSPVLVIYQDYKRPSGIPERFSGSNSGNTATLTISGTQAMDEADYYCQAWDTNTVLFGGGTKLTVL

SEQ ID NO: 27427 - DNA, 318 bp, Artificial Sequence
  Description of Artificial Sequence: Synthetic polynucleotide
gcctatgacctgactcagccaccctcagtgtccgtgtccccaggacagacagccagaatcacctgctctggagataaattggggggaaaatatgcttcctggtatcaacagaagccaggccagtcccctgtgctggtcatctatcaagataggaagcggccctcagggatccctgagcgattctctggctccaactctgggaacacagccactctgaccatcagcgggacccaggctatggatgaggctgactattactgtcaggcgtgggacaagaacactgtggtattcggcggagggaccaagctgaccgtccta

SEQ ID NO: 27428 - protein, 106 aa, Artificial Sequence
  Description of Artificial Sequence: Synthetic polypeptide
AYDLTQPPSVSVSPGQTARITCSGDKLGGKYASWYQQKPGQSPVLVIYQDRKRPSGIPERFSGSNSGNTATLTISGTQAMDEADYYCQAWDKNTVVFGGGTKLTVL

SEQ ID NO: 27429 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagtaagcggccctcagggatccctgagcgattctctggctccaactctgggaacacagccactctgaccatcagcgggacccaggctatggatgaggctgactattactgtcaggcgtgggacaacagcactgcggtattcggcggagggaccaagctgaccgtccta

SEQ ID NO: 27430 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDNSTAVFGGGTKLTVL

SEQ ID NO: 27431 - DNA, 330 bp, Artificial Sequence
  Description of Artificial Sequence: Synthetic polynucleotide
aattttatgctgactcagccccactctgtgtcggagtctccggggaagacggtaaccatctcctgcacccgcagcagtggcagcattaccggcaactatgtgcagtggcaccagcagcgcccgggcaattcccccaccactttgatctatgaggataaaaaaagaccctctggggtccctgatcggttctctggctccatcgacagctcctccaactctgcctccctcaccatctctggactgaagactgaggacgaggctgactattactgtcagtcttattatagcggcaattgggtgttcggcggagggaccaagctgaccgtcctg

SEQ ID NO: 27432 - protein, 110 aa, Artificial Sequence
  Description of Artificial Sequence: Synthetic polypeptide
NFMLTQPHSVSESPGKTVTISCTRSSGSITGNYVQWHQQRPGNSPTTLIYEDKKRPSGVPDRFSGSIDSSSNSASLTISGLKTEDEADYYCQSYYSGNWVFGGGTKLTVL

SEQ ID NO: 27433 - DNA, 318 bp, Artificial Sequence
  Description of Artificial Sequence: Synthetic polynucleotide
tcctatgagttgagtcagccaccctcagtgtccgtgtccccaggacagacagccagcatcacctgctctggagataaattgggggataaatattcttgctggtatcagcagaagccaggccagtcccctgtgctggtcatctatcaagatagtaagcggccctcagggatccctgcacgattctctggctccaactctgggaacacagccactctgaccatcagcgggacccaggctatggatgaggctgattattactgtcaggcgtgggacagcaacactgcggtattcggcggagggaccaaactgaccgtccta

SEQ ID NO: 27434 - protein, 106 aa, Artificial Sequence
  Description of Artificial Sequence: Synthetic polypeptide
SYELSQPPSVSVSPGQTASITCSGDKLGDKYSCWYQQKPGQSPVLVIYQDSKRPSGIPARFSGSNSGNTATLTISGTQAMDEADYYCQAWDSNTAVFGGGTKLTVL

SEQ ID NO: 27435 - DNA, 318 bp, Artificial Sequence
  Description of Artificial Sequence: Synthetic polynucleotide
tcctatgacctgactcagccaccctcagtgtccgtgtccccaggacagacagccagcatcacctgctctggagataaattgggggataaatatgcttgttggtatcagcagaagccaggccagtcccctatactggtcatctatcaagattacaagcggccctcagggatccctgagcgattctctggctccaactctgggaacacagccactctgaccatcagcgggacccaggctatggatgaggctgactattattgtcaggcgtgggacaacagcactatggtattcggcggagggaccaggctgaccgtccta

SEQ ID NO: 27436 - protein, 106 aa, Artificial Sequence
  Description of Artificial Sequence: Synthetic polypeptide
SYDLTQPPSVSVSPGQTASITCSGDKLGDKYACWYQQKPGQSPILVIYQDYKRPSGIPERFSGSNSGNTATLTISGTQAMDEADYYCQAWDNSTMVFGGGTRLTVL

SEQ ID NO: 27437 - DNA, 318 bp, Artificial Sequence
  Description of Artificial Sequence: Synthetic polynucleotide
gcctatgacctgactcagccaccctcagtgtccgtgtccccaggacagacagccagcatcacctgctctggagataaattggggggaaaatatgcttcctggtatcaacagaagccaggccagtcccctgtgctggtcatctatcaagataggaagcggccctcagggatccctgagcgattctctggctccaactctgggaacacagccactctgaccatcagcgggacccaggctatggatgaggctgactattactgtcaggcgtgggacaagaacactgtggtattcggcggagggaccaagctgaccgtccta

SEQ ID NO: 27438 - protein, 106 aa, Artificial Sequence
  Description of Artificial Sequence: Synthetic polypeptide
AYDLTQPPSVSVSPGQTASITCSGDKLGGKYASWYQQKPGQSPVLVIYQDRKRPSGIPERFSGSNSGNTATLTISGTQAMDEADYYCQAWDKNTVVFGGGTKLTVL

SEQ ID NO: 27439 - DNA, 324 bp, Artificial Sequence
  Description of Artificial Sequence: Synthetic polynucleotide
tcttctgagctgactcaggaccctgctgtgtctgtggccttgggacagacagtcaggatcacatgccaaggagacagcctcagaagctattatgcaagctggtaccagcagaagccaggacaggcccctatacttgtcatctatgctaaaaacaaccggccctcagggatcccagaccgattctctggctccaactcaggaaacacagcttccttgaccatcactggggctcaggcggaagatgaggctgactattactgtaactcccgggacagcagtggcagccatgtggtattcggcggagggaccaaactgaccgtccta

SEQ ID NO: 27440 - protein, 108 aa, Artificial Sequence
  Description of Artificial Sequence: Synthetic polypeptide
SSELTQDPAVSVALGQTVRITCQGDSLRSYYASWYQQKPGQAPILVIYAKNNRPSGIPDRFSGSNSGNTASLTITGAQAEDEADYYCNSRDSSGSHVVFGGGTKLTVL

SEQ ID NO: 27441 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatcgcaagcggccctcagggatccctgagcgattctctggctccaactctgggaacacagccaccctgaccatcagcgggacccaggctatggatgaggctgactattactgtcaggcgtgggacatcagcacttatgtggtattcggcggagggaccaaactgaccgtccta

SEQ ID NO: 27442 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDRKRPSGIPERFSGSNSGNTATLTISGTQAMDEADYYCQAWDISTYVVFGGGTKLTVL

SEQ ID NO: 27443 - DNA, 324 bp, Artificial Sequence
  Description of Artificial Sequence: Synthetic polynucleotide
tcttctgagctgactcaggaccctgctgtgtctgtggccttgggacagacagtcaggatcacatgccaaggagacagcctcagaaactattatgtaagctggtaccagcagaagccaggacaggcccctatacttgtcatctatactaaaaacagccggccctcagggatcccagaccgattctctggctccacctcaggaaacacagcttccttgaccatcactgggactcaggcggaagatgaggctgactattactgtaactcccgggacagcagtggcaaccatgtggtattcggcggagggaccaagctgaccgtccta

SEQ ID NO: 27444 - protein, 108 aa, Artificial Sequence
  Description of Artificial Sequence: Synthetic polypeptide
SSELTQDPAVSVALGQTVRITCQGDSLRNYYVSWYQQKPGQAPILVIYTKNSRPSGIPDRFSGSTSGNTASLTITGTQAEDEADYYCNSRDSSGNHVVFGGGTKLTVL

SEQ ID NO: 27445 - DNA, 324 bp, Artificial Sequence
  Description of Artificial Sequence: Synthetic polynucleotide
tcttctgagctgactcaggaccctgctgtgtctgtggccttgggacagacagtcaggatcacatgccaaggagacagcctcagaaactattatgcaagctggtaccagcagaagccaggacaggcccctatacttgtcatctatactaaaaacagccggccctcagggatcccagaccgattctctggctccacctcaggaaacacagcttccttgaccatcactggggctcaggcggaagatgaggctgactattactgtaactcccgggacagcagtggcaaccatgtggtattcggcggagggaccaagctgaccgtccta

SEQ ID NO: 27446 - protein, 108 aa, Artificial Sequence
  Description of Artificial Sequence: Synthetic polypeptide
SSELTQDPAVSVALGQTVRITCQGDSLRNYYASWYQQKPGQAPILVIYTKNSRPSGIPDRFSGSTSGNTASLTITGAQAEDEADYYCNSRDSSGNHVVFGGGTKLTVL

SEQ ID NO: 27447 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggaaataaattggggaataaatatgtttgctggtatcagcagaggccaggccagtcccctgtgctggtcatctctcaagatagcaggcggccctcagggatccctgagcgattctctggctccaactctgggaacacagccactctgaccatcagcgggacccaggctatggatgaggctgactattactgtcaggcgtgggacagcttcactgtggtattcggcggagggaccaagctgaccgtccta

SEQ ID NO: 27448 - protein, 106 aa, Artificial Sequence
  Description of Artificial Sequence: Synthetic polypeptide
SYELTQPPSVSVSPGQTASITCSGNKLGNKYVCWYQQRPGQSPVLVISQDSRRPSGIPERFSGSNSGNTATLTISGTQAMDEADYYCQAWDSFTVVFGGGTKLTVL

SEQ ID NO: 27449 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttggacgttttaaccttgtctcctggtaccaacagcacccaggctacgcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcacctatgtggtattcggcggagggaccaagctgaccgtcctg

SEQ ID NO: 27450 - protein, 111 aa, Artificial Sequence
  Description of Artificial Sequence: Synthetic polypeptide
QSALTQPASVSGSPGQSITISCTGTSSDVGRFNLVSWYQQHPGYAPKLMIYEVSKRPSGVSNRFSGSKSGNTASLTISGLQAEDEADYYCCSYAGSSTYVVFGGGTKLTVL

SEQ ID NO: 27451 - DNA, 318 bp, Artificial Sequence; identical to SEQ ID NO: 27435
  Description of Artificial Sequence: Synthetic polynucleotide

SEQ ID NO: 27452 - protein, 106 aa, Artificial Sequence; identical to SEQ ID NO: 27436
  Description of Artificial Sequence: Synthetic polypeptide

SEQ ID NO: 27453 - DNA, 333 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttggacgttttaaccttgtctcctggtaccaacaccacccaggcaacgcccccaaactcatgatttatgaagtcagtaagcggccctcaggggtttctaatcgcttctctggctccaagtctggcaacacggcctccctgacaatctctgggctccaggctgaggacgaggctgattattactgctgctcatatgcaggtagtagcacctttgtagtattcggcggagggaccaagctgaccgtccta

SEQ ID NO: 27454 - protein, 111 aa, Artificial Sequence
  Description of Artificial Sequence: Synthetic polypeptide
QSALTQPASVSGSPGQSITISCTGTSSDVGRFNLVSWYQHHPGNAPKLMIYEVSKRPSGVSNRFSGSKSGNTASLTISGLQAEDEADYYCCSYAGSSTFVVFGGGTKLTVL

SEQ ID NO: 27455 - DNA, 324 bp, Artificial Sequence
  Description of Artificial Sequence: Synthetic polynucleotide
tcttctgagctgactcaggaccctgctgtgtctgtggccttgggacagacagtcaggatcacatgccaaggagacagtctcagaaactattatgcaagctggtaccagcagaagccaggacaggcccctgtatttgtcatctatggtaaaaacaaccggccctcagggatcccagaccgattctctggctccaggtcaggaaacacagcttccttgaccatcactggggctcaggcggaagatgaggctgactattactgtaactcccgggacagcagtggtaaccattgggtgttcggcggagggaccaaactgaccgtccta

SEQ ID NO: 27456 - protein, 108 aa, Artificial Sequence
  Description of Artificial Sequence: Synthetic polypeptide
SSELTQDPAVSVALGQTVRITCQGDSLRNYYASWYQQKPGQAPVFVIYGKNNRPSGIPDRFSGSRSGNTASLTITGAQAEDEADYYCNSRDSSGNHWVFGGGTKLTVL

SEQ ID NO: 27457 - DNA, 321 bp, Artificial Sequence
  Description of Artificial Sequence: Synthetic polynucleotide
tcctatgagctgactcagccaccctcagtgtccgtgtccccaggacagacagccagtatcacctgctctggagataaattgggggataaatatgtttgctggtatcaacagaggccgggccagtcccctgtgctggtcatctatcaggatagtaagcggccctcagggatccctgagcgattctctggctccaactctgggaacacagccactctgaccatccgcgggacccaggctatggatgaggctgactattactgtcaggcgtgggacagcaacactgcagtggtattcggcggagggaccaagctgaccgtccta

SEQ ID NO: 27458 - protein, 107 aa, Artificial Sequence
  Description of Artificial Sequence: Synthetic polypeptide
SYELTQPPSVSVSPGQTASITCSGDKLGDKYVCWYQQRPGQSPVLVIYQDSKRPSGIPERFSGSNSGNTATLTIRGTQAMDEADYYCQAWDSNTAVVFGGGTKLTVL

SEQ ID NO: 27459 - DNA, 330 bp, Artificial Sequence
  Description of Artificial Sequence: Synthetic polynucleotide
cagtctgtgttgacgcagccgccctcagtgtctggggccccagggcagagggtcaccatctcctgcactgggagcagctccaacttcgggacagattatgatgtacactggtaccagcaatttccaggaacagcccccaaactcctcatctatggtcacagcaaccggccctcaggggtccctgaccgattttctggctccaagtctggcacctcagcctccctggccatcactgggctccaggctgaggatgaggctgattattactgccagtcctatgatagaagcctgaatgtggtcttcggcggagggaccaagctgaccgtccta

SEQ ID NO: 27460 - protein, 110 aa, Artificial Sequence
  Description of Artificial Sequence: Synthetic polypeptide
QSVLTQPPSVSGAPGQRVTISCTGSSSNFGTDYDVHWYQQFPGTAPKLLIYGHSNRPSGVPDRFSGSKSGTSASLAITGLQAEDEADYYCQSYDRSLNVVFGGGTKLTVL

SEQ ID NO: 27461 - DNA, 318 bp, Artificial Sequence
  Description of Artificial Sequence: Synthetic polynucleotide
tcctatgagctgactcagacaccctcagtgtccgtgtccccaggacagacagccagcatcacctgctctggagatagattgggggataaatatgcttgctggtatcagcagaagccaggccagtcccctgtgctggtcatctatgaagataggaagcggccctcagggatccctgagcgattctctggctccaactctgggaacacagccactctgaccatcagcgggacccaggctatggatgagggtgactattactgtcaggcgtgggacagtaggaaagtggtattcggcggagggaccaagctgaccgtccta

SEQ ID NO: 27462 - protein, 106 aa, Artificial Sequence
  Description of Artificial Sequence: Synthetic polypeptide
SYELTQTPSVSVSPGQTASITCSGDRLGDKYACWYQQKPGQSPVLVIYEDRKRPSGIPERFSGSNSGNTATLTISGTQAMDEGDYYCQAWDSRKVVFGGGTKLTVL

SEQ ID NO: 27463 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggagataaattgggggaaaaatatgcttgctggtatcagcagaagccaggccagtcccctgtactggtcatctatcaagatagaaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 27464 - protein, 106 aa, Artificial Sequence
  Description of Artificial Sequence: Synthetic polypeptide
SYELTQPPSVSVSPGQTASITCSGDKLGEKYACWYQQKPGQSPVLVIYQDRKRPSGIPERFSGSNSGNTATLTISGTQAMDEADYYCQAWDSSTAVFGGGTKLTVL

SEQ ID NO: 27465 - DNA, 318 bp, Artificial Sequence
  Description of Artificial Sequence: Synthetic polynucleotide
tcctatgagctgactcagccaccctcagtgtccgtgtacccaggacagacagccagcatcacctgctctggagataaattgggggataaatatgttagctggtatcaacagaagccaggccagtcccctgttctggtcatctatcaagatagcaagcggccctcagggatccctgagcgattctctggctccaactctgggaacccagcctctctgaccatcagcgggacccaggctatggatgaggctgactattactgtcaggcgtgggacatcaccactgcggtattcggcggagggaccaagctgaccgtccta

SEQ ID NO: 27466 - protein, 106 aa, Artificial Sequence
  Description of Artificial Sequence: Synthetic polypeptide
SYELTQPPSVSVYPGQTASITCSGDKLGDKYVSWYQQKPGQSPVLVIYQDSKRPSGIPERFSGSNSGNPASLTISGTQAMDEADYYCQAWDITTAVFGGGTKLTVL

SEQ ID NO: 27467 - DNA, 318 bp, Artificial Sequence
  Description of Artificial Sequence: Synthetic polynucleotide
tcctatgagctgactcagacaccctcagtgtccgtgtccccaggacagacagccagcatcacctgctctggagataaattgggggataaatatgcttgctggtatcagcagaagccaggccagtcccctgtgctggtcatctatgaagataggaagcggccctcagggatccctgagcgattctctggctccaactctgggaacacagccactctgaccatcagcgggacccaggctatggatgaggctgactattactgtcaggcgtgggacagcaggaaagtggtattcggcggagggaccaagctgaccgtccta

SEQ ID NO: 27468 - protein, 106 aa, Artificial Sequence
  Description of Artificial Sequence: Synthetic polypeptide
SYELTQTPSVSVSPGQTASITCSGDKLGDKYACWYQQKPGQSPVLVIYEDRKRPSGIPERFSGSNSGNTATLTISGTQAMDEADYYCQAWDSRKVVFGGGTKLTVL

SEQ ID NO: 27469 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatattgtgacctggtaccagcagctcccaggaacggcccccaaactcctcatctatagtaatgatcagcggccctcaggggtccctgaccgattctctggctccaagtctggcacctcagcctccctggccatcagtgggctccagtctgaggatgagactgattattactgtacagcatgggatgacagcctgaatggttgggtgttcggcggagggaccacgctgaccgtccta

SEQ ID NO: 27470 - protein, 110 aa, Artificial Sequence
  Description of Artificial Sequence: Synthetic polypeptide
QSVLTQPPSASGTPGQRVTISCSGSSSNIGSNIVTWYQQLPGTAPKLLIYSNDQRPSGVPDRFSGSKSGTSASLAISGLQSEDETDYYCTAWDDSLNGWVFGGGTTLTVL

SEQ ID NO: 27471 - DNA, 333 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaacatcggggcaggttttgaagtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtccta

SEQ ID NO: 27472 - protein, 111 aa, Artificial Sequence
  Description of Artificial Sequence: Synthetic polypeptide
QSVLTQPPSVSGAPGQRVTISCTGSSSNIGAGFEVHWYQQLPGTAPKLLIYGNSNRPSGVPDRFSGSKSGTSASLAITGLQAEDEADYYCQSYDSSLSGYVFGTGTKVTVL

SEQ ID NO: 27473 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatattgtgacctggtaccagcagctcccaggaacggcccccaaactcctcatctatagtaatgatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccacgctgaccgtccta

SEQ ID NO: 27474 - protein, 110 aa, Artificial Sequence
  Description of Artificial Sequence: Synthetic polypeptide
QSVLTQPPSASGTPGQRVTISCSGSSSNIGSNIVTWYQQLPGTAPKLLIYSNDQRPSGVPDRFSGSKSGTSASLAISGLQSEDEADYYCAAWDDSLNGWVFGGGTTLTVL

SEQ ID NO: 27475 - DNA, 318 bp, Artificial Sequence
  Description of Artificial Sequence: Synthetic polynucleotide
tcctatgagctgactcagccaccctcagtgttcgtgtccccaggacagacagccagcatcacctcctctggagataaattgggggataaatatgtttcctggtatcagcagaagccaggccagtcccctgtgctggtcatctatcaagatagaaagcggccctcagggatccctgagcgattctctggctccaattctgggaatacagccactctgaccatcagcgggacccaggctatggatgaggctgactattattgtcaggcgtgggacaacagcactgtggtattcggcggagggaccaagctgaccgtccta

SEQ ID NO: 27476 - protein, 106 aa, Artificial Sequence
  Description of Artificial Sequence: Synthetic polypeptide
SYELTQPPSVFVSPGQTASITSSGDKLGDKYVSWYQQKPGQSPVLVIYQDRKRPSGIPERFSGSNSGNTATLTISGTQAMDEADYYCQAWDNSTVVFGGGTKLTVL

SEQ ID NO: 27477 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaatacggcctccctgaccatctctgggctccaggctgaggacgaggctgattattactgcaactcatatacaagcaacatcacttgggtgttcggcggagggaccaagctgaccgtccta

SEQ ID NO: 27478 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCNSYTSNITWVFGGGTKLTVL

SEQ ID NO: 27479 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggaactaaattgggggataaatatgtttgctggtatcaacagaagccaggccagtcccctgtgttggtcatcaatcaagatacaatgcggccctcagggatccctgagcgattctctggctccaactctgggaacacagccactctgaccatcagcgggacccaggctatggatgaggctgactattactgtcagacgtgggacagcagcactgcggttttcggcggagggaccacgctgaccgtccta

SEQ ID NO: 27480 - protein, 106 aa, Artificial Sequence
  Description of Artificial Sequence: Synthetic polypeptide
SYELTQPPSVSVSPGQTASITCSGTKLGDKYVCWYQQKPGQSPVLVINQDTMRPSGIPERFSGSNSGNTATLTISGTQAMDEADYYCQTWDSSTAVFGGGTTLTVL

SEQ ID NO: 27481 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcaactccaacatcggaaataatattgtcacctggtaccagcagctcccaggaacggcccccaaactcctcatctatgttaatgatcagcggccctcaggggtccctgaccgattctctggctccaagtctggcacctctgcctccctggccatcagtgggctccagtctgaggatgaggctgattattactgtgcagcatgggatgacagcctgaatggttgggtgttcggcggggggaccacgctgaccgtccta

SEQ ID NO: 27482 - protein, 110 aa, Artificial Sequence
  Description of Artificial Sequence: Synthetic polypeptide
QSVLTQPPSASGTPGQRVTISCSGSNSNIGNNIVTWYQQLPGTAPKLLIYVNDQRPSGVPDRFSGSKSGTSASLAISGLQSEDEADYYCAAWDDSLNGWVFGGGTTLTVL

SEQ ID NO: 27483 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtcatattgttacctggtaccagcagctcccaggaacggcccccaaactcctcatctacagtaatgatcagcggccctcaggggtccctgaccgattctctggctccaagtctggcacctcagcctccctggccatcagtgggctccagtctgaggatgaggctgattattactgtgcagtatgggatgacagcctgattggttgggtgttcggcggagggaccacgctgaccgtccta

SEQ ID NO: 27484 - protein, 110 aa, Artificial Sequence
  Description of Artificial Sequence: Synthetic polypeptide
QSVLTQPPSASGTPGQRVTISCSGSSSNIGSHIVTWYQQLPGTAPKLLIYSNDQRPSGVPDRFSGSKSGTSASLAISGLQSEDEADYYCAVWDDSLIGWVFGGGTTLTVL

SEQ ID NO: 27485 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatattgttacctggtaccagcagctcccaggaacggcccccaaactcctcatctatagtaataatcagcggccctcaggggtccctgaccgattctctggctccaagtctggcacctcagcctccctggccatcagtggactccagtctgaggatgaggctgattattgctgtgcagcatgggatgacagcctgaatggttgggtgttcggcggagggaccacgctgaccgtccta

SEQ ID NO: 27486 - protein, 110 aa, Artificial Sequence
  Description of Artificial Sequence: Synthetic polypeptide
QSVLTQPPSASGTPGQRVTISCSGSSSNIGSNIVTWYQQLPGTAPKLLIYSNNQRPSGVPDRFSGSKSGTSASLAISGLQSEDEADYCCAAWDDSLNGWVFGGGTTLTVL

SEQ ID NO: 27487 - DNA, 318 bp, Artificial Sequence
  Description of Artificial Sequence: Synthetic polynucleotide
tcctatgagctgactcagccaccctcagcgtccgtgtccccaggacagacagccagcatcacctgctctggagataaactgggggaaaaatatgcttgctggtatcagcagaagccaggccagtcccctgtgttggtcatctatcaagataggaagcggccctcagggatccctgagcgattctctggctccaattctgggaacacagccactctgaccatcagcgggacccaggctatggatgaggctgactattactgtcaggcgtgggacagcagcactgtggtattcggcggagggaccaaactgaccgtccta

SEQ ID NO: 27488 - protein, 106 aa, Artificial Sequence
  Description of Artificial Sequence: Synthetic polypeptide
SYELTQPPSASVSPGQTASITCSGDKLGEKYACWYQQKPGQSPVLVIYQDRKRPSGIPERFSGSNSGNTATLTISGTQAMDEADYYCQAWDSSTVVFGGGTKLTVL

SEQ ID NO: 27489 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagagaaattgggggaaaaatttgcttgctggtctcagcagaagccaggccagtcccctgtgttggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 27490 - protein, 106 aa, Artificial Sequence
  Description of Artificial Sequence: Synthetic polypeptide
SYELTQPPSVSVSPGQTASITCSGEKLGEKFACWSQQKPGQSPVLVIYQDSKRPSGIPERFSGSNSGNTATLTISGTQAMDEADYYCQAWDSSTVVFGGGTKLTVL

SEQ ID NO: 27491 - DNA, 318 bp, Artificial Sequence
  Description of Artificial Sequence: Synthetic polynucleotide
tcctatgcgctgactcagccaccctcagcgtccgtgtccccaggacagacagccagcatcacctgctctggagataaactgggggaaaaatatgcttgctggtatcagcagaagccaggccagtcccctgtgttggtcatctatcaagataggaagcggccctcagggatccctgagcgattctctggctccaattctgggaacacagccactctgaccatcagcgggacccaggctatggatgaggctgactattactgtcaggcgtgggacagcagcactgtggtattcggcggagggaccaaactgaccgtccta

SEQ ID NO: 27492 - protein, 106 aa, Artificial Sequence
  Description of Artificial Sequence: Synthetic polypeptide
SYALTQPPSASVSPGQTASITCSGDKLGEKYACWYQQKPGQSPVLVIYQDRKRPSGIPERFSGSNSGNTATLTISGTQAMDEADYYCQAWDSSTVVFGGGTKLTVL

SEQ ID NO: 27493 - DNA, 315 bp, Artificial Sequence
  Description of Artificial Sequence: Synthetic polynucleotide
tcctatgagctgactcagccaccctcagtgtccgtgtccccaggacagacagccaacatcacctgctctggagataaattggggaataaatatgcttgctggtatcagcagaagccaggccagtcccctgtattggtcatctatcaagataggaagcggccctcagggatccctgagcgattctctggctccaactctgggaacacagccactctgaccatcagcgggacccaggctatggatgaggctgactattactgtcaggcgtgggacagcagcactgcattcggcggagggaccaagctgaccgtcctc

SEQ ID NO: 27494 - protein, 105 aa, Artificial Sequence
  Description of Artificial Sequence: Synthetic polypeptide
SYELTQPPSVSVSPGQTANITCSGDKLGNKYACWYQQKPGQSPVLVIYQDRKRPSGIPERFSGSNSGNTATLTISGTQAMDEADYYCQAWDSSTAFGGGTKLTVL

SEQ ID NO: 27495 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattttctggctccaagtctggcacgtcagccaccctgggcatcaccggactccagactggggacgaggccgattattactgcggaacatgggatatcagtctgagtgttggggtattcggcggagggaccaagctgaccgtccta

SEQ ID NO: 27496 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDISLSVGVFGGGTKLTVL

SEQ ID NO: 27497 - DNA, 318 bp, Artificial Sequence
  Description of Artificial Sequence: Synthetic polynucleotide
tcctatgaactgactcagtcaccctcggtgtccgtgtccccaggacagacagccagcatcacctgttctggagataaattgggggataaatatacttgctggtatcagaagaagccaggccagtcccctgtgctggtcatctatcaagataacaagcggccctcagggatccctgagcgattctctggctccaactctgggaacacagccactctgaccatcagcgggacccaggctatggatgaggctgactatttctgtcaggcgtggaacaactacactgtggtattcggcggagggaccaagctgaccgctcta

SEQ ID NO: 27498 - protein, 106 aa, Artificial Sequence
  Description of Artificial Sequence: Synthetic polypeptide
SYELTQSPSVSVSPGQTASITCSGDKLGDKYTCWYQKKPGQSPVLVIYQDNKRPSGIPERFSGSNSGNTATLTISGTQAMDEADYFCQAWNNYTVVFGGGTKLTAL

SEQ ID NO: 27499 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataggaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 27500 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDRKRPSGIPERFSGSNSGNTATLTISGTQAMDEADYYCQAWDSSTVVFGGGTKLTVL

SEQ ID NO: 27501 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggaaataaatatgcttgctggtatcagcagaagccaggccagtcccctgtactggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaaactgaccgtccta

SEQ ID NO: 27502 - protein, 106 aa, Artificial Sequence
  Description of Artificial Sequence: Synthetic polypeptide
SYELTQPPSVSVSPGQTASITCSGDKLGNKYACWYQQKPGQSPVLVIYQDSKRPSGIPERFSGSNSGNTATLTISGTQAMDEADYYCQAWDSSTVVFGGGTKLTVL

SEQ ID NO: 27503 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagataacaagcggccctcagggatccctgagcgcttctctggctccaactctgggaacacagccactctgaccatcagcgggacccaggctatggatgaggctgactattactgtcaggcgtggaacaacaacactgtaatgttcggcggagggaccaagctgaccgtccta

SEQ ID NO: 27504 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDNKRPSGIPERFSGSNSGNTATLTISGTQAMDEADYYCQAWNNNTVMFGGGTKLTVL

SEQ ID NO: 27505 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggagataaattgggggataaatatgcttcttggtatcagcagaggccaggccagtcccctgtgttggtcatctatcaagataacaagcggccctcagggatccctgagcgattctctggctccaactctgggaacacagccactctgaccatcagcgggacccaggctatggatgaggctgactattactgtcaggcgtgggacaacaacactgtggtcttcggcggagggaccaagctgaccgtccta

SEQ ID NO: 27506 - protein, 106 aa, Artificial Sequence
  Description of Artificial Sequence: Synthetic polypeptide
SYELTQPPSVSVSPGQTASITCSGDKLGDKYASWYQQRPGQSPVLVIYQDNKRPSGIPERFSGSNSGNTATLTISGTQAMDEADYYCQAWDNNTVVFGGGTKLTVL

SEQ ID NO: 27507 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccttgagcgattctctggctccaattctgggaacacagccactctgaccatcagcggaacccaggctatggatgaggctgactattactgtcaggcgtgggacagcagcacttatgtggtattcggcggagggaccaagctgaccgtccta

SEQ ID NO: 27508 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDSKRPSGILERFSGSNSGNTATLTISGTQAMDEADYYCQAWDSSTYVVFGGGTKLTVL

SEQ ID NO: 27509 - DNA, 318 bp, Artificial Sequence; identical to SEQ ID NO: 27487
  Description of Artificial Sequence: Synthetic polynucleotide

SEQ ID NO: 27510 - protein, 106 aa, Artificial Sequence; identical to SEQ ID NO: 27488
  Description of Artificial Sequence: Synthetic polypeptide

SEQ ID NO: 27511 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggaaataaattgggggataaatatgcttcttggtatcagcagaggccaggccagtcccctgtattagtcatctatcaagataacaagcggccctcagggatccctgagcgattctctggctccaactctggaaacacagccactctgaccatcagcgggacccagactatggatgaggctgactattactgtcaggcgtgggacaacaacactgtggtcttcggcggagggaccaagctgaccgtccta

SEQ ID NO: 27512 - protein, 106 aa, Artificial Sequence
  Description of Artificial Sequence: Synthetic polypeptide
SYELTQPPSVSVSPGQTASITCSGNKLGDKYASWYQQRPGQSPVLVIYQDNKRPSGIPERFSGSNSGNTATLTISGTQTMDEADYYCQAWDNNTVVFGGGTKLTVL

SEQ ID NO: 27513 - DNA, 315 bp, Artificial Sequence
  Description of Artificial Sequence: Synthetic polynucleotide
tcctatgagctgactcagccaccctcagtgtccgtgtccccaggacagacagccaacatcacctgctctggagataaattggggaataaatatgcttgctggtatcagcagaagccaggccagtcccctgtattggtcatttatcaagataggaagcggccctcagggatccctgagcgattctctggctccaactctgggaacacagccattctgaccatcagcgggacccaggctatggatgaggctgactattactgtcaggcgtgggacagcagcactgctttcggcggagggaccaagctgaccgtcctc

SEQ ID NO: 27514 - protein, 105 aa, Artificial Sequence
  Description of Artificial Sequence: Synthetic polypeptide
SYELTQPPSVSVSPGQTANITCSGDKLGNKYACWYQQKPGQSPVLVIYQDRKRPSGIPERFSGSNSGNTAILTISGTQAMDEADYYCQAWDSSTAFGGGTKLTVL

SEQ ID NO: 27515 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggaaaaatatgcttgctggtatcagcagaagccaggccagtcccctgtgttggtcatctatcaagatagcaagcggccctcagggatccctgagcgattctctggctccaattctgggaacacagccactctgaccatcagcgggacccaggctatggatgaggctgactattactgtcaggcgtgggacagcagcactgtggttttcggcggagggaccaaactgaccgtccta

SEQ ID NO: 27516 - protein, 106 aa, Artificial Sequence
  Description of Artificial Sequence: Synthetic polypeptide
SYELTQPPSVSVSPGQTASITCSGDKLGEKYACWYQQKPGQSPVLVIYQDSKRPSGIPERFSGSNSGNTATLTISGTQAMDEADYYCQAWDSSTVVFGGGTKLTVL

SEQ ID NO: 27517 - DNA, 318 bp, Artificial Sequence
  Description of Artificial Sequence: Synthetic polynucleotide
tcctatgacctgactcagccaccctcagtgtccgtgtccccaggacagacagccagcatcacctgctctggagataaattggggaataaatatgcttgctggtatcagcagaagccaggccagtcccctgtggtggtcatctatcaagataggaagcggccctcagggatccctgagcgattctctggctccaattctgggaacacagccactctgaccatcagcgggacccaggctatggatgaggctgactattactgtcaggcgtgggacagcagcactgcggtattcggcggagggaccaagctgaccgtccta

SEQ ID NO: 27518 - protein, 106 aa, Artificial Sequence
  Description of Artificial Sequence: Synthetic polypeptide
SYDLTQPPSVSVSPGQTASITCSGDKLGNKYACWYQQKPGQSPVVVIYQDRKRPSGIPERFSGSNSGNTATLTISGTQAMDEADYYCQAWDSSTAVFGGGTKLTVL

SEQ ID NO: 27519 - DNA, 318 bp, Artificial Sequence
  Description of Artificial Sequence: Synthetic polynucleotide
tcctatgacctgactcagccaccctcagtgtccgtgtccccaggacagacagccagcatcacctgctctggagatagattggggaataaatatgcttcctggtatcagcagaagccaggccagtcccctgtggtggtcatctatcaggataggaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 27520 - protein, 106 aa, Artificial Sequence
  Description of Artificial Sequence: Synthetic polypeptide
SYDLTQPPSVSVSPGQTASITCSGDRLGNKYASWYQQKPGQSPVVVIYQDRKRPSGIPERFSGSNSGNTATLTISGTQAMDEADYYCQAWDSSTAVFGGGTKLTVL

SEQ ID NO: 27521 - DNA, 318 bp, Artificial Sequence
  Description of Artificial Sequence: Synthetic polynucleotide
tcctatgacctgactcagccaccctcagtgtccgtgtccccaggacagacagccagcatcacctgctctggagataaattggggaataaatatgcttgctggtatcagcagaagccaggccagtcccctgtggtggtcatctatcaagataggaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 27522 - protein, 106 aa, Artificial Sequence; identical to SEQ ID NO: 27518
  Description of Artificial Sequence: Synthetic polypeptide

SEQ ID NO: 27523 - DNA, 318 bp, Artificial Sequence; identical to SEQ ID NO: 27521
  Description of Artificial Sequence: Synthetic polynucleotide

SEQ ID NO: 27524 - protein, 106 aa, Artificial Sequence; identical to SEQ ID NO: 27518
  Description of Artificial Sequence: Synthetic polypeptide

SEQ ID NO: 27525 - DNA, 318 bp, Artificial Sequence
  Description of Artificial Sequence: Synthetic polynucleotide
tcctatgacctgactcagccaccctcagtgtccgtgtccccaggacagacagccagcatcacctgctctggagataaattggggaataaatatacttgctggtatcagcagaagccaggccagtcccctgtggtggtcatctatcaagataggaagcggccctcagggatccctgagcgattctctggctccaattctgggaacacagccactctgaccatcagcgggacccaggctatggatgaggctgactattactgtcaggcgtgggacagcagcactgcggtattcggcggagggaccaagctgaccgtccta

SEQ ID NO: 27526 - protein, 106 aa, Artificial Sequence
  Description of Artificial Sequence: Synthetic polypeptide
SYDLTQPPSVSVSPGQTASITCSGDKLGNKYTCWYQQKPGQSPVVVIYQDRKRPSGIPERFSGSNSGNTATLTISGTQAMDEADYYCQAWDSSTAVFGGGTKLTVL

SEQ ID NO: 27527 - DNA, 330 bp, Artificial Sequence
  Description of Artificial Sequence: Synthetic polynucleotide
aattttatgctgactcagccccactctgtgtcggagtctccggggaagacggtaaccatctcctgcacccgcagcaatggcagcattgtcagcaactatgtgcagtggtaccagcagcgcccgggcagttcccccaccactatgatctatgaggatagccgaagaccctctggggtccctgatcggttctctggctccatcgacagctcctccaactctgcctccctcaccatctctggactgaagactgaggacgaggctgactactcctgtcagtcttatgatggcatcaatgtggtattcggcggagggaccaagctgaccgtccta

SEQ ID NO: 27528 - protein, 110 aa, Artificial Sequence
  Description of Artificial Sequence: Synthetic polypeptide
NFMLTQPHSVSESPGKTVTISCTRSNGSIVSNYVQWYQQRPGSSPTTMIYEDSRRPSGVPDRFSGSIDSSSNSASLTISGLKTEDEADYSCQSYDGINVVFGGGTKLTVL

SEQ ID NO: 27529 - DNA, 330 bp, Artificial Sequence
  Description of Artificial Sequence: Synthetic polynucleotide
aattttatgctgactcagccccactctgtgtcggagtctccggggaagacggtaaccatctcctgcacccgcagcaatggcagcattgtcagcaactatgtgcagtggtaccagcagcgcccgggcagttcccccaccactgtgatctatgaggataaaagaagaccctcaggggtccctgatcggttctctggctccatcgacagctcctccaactctgcctccctcaccatctctggactgaagactgaggacgaggctgactactactgtcagtcttatgatagcatcaatgtggtattcggcggagggaccaagctgaccgtccta

SEQ ID NO: 27530 - protein, 110 aa, Artificial Sequence
  Description of Artificial Sequence: Synthetic polypeptide
NFMLTQPHSVSESPGKTVTISCTRSNGSIVSNYVQWYQQRPGSSPTTVIYEDKRRPSGVPDRFSGSIDSSSNSASLTISGLKTEDEADYYCQSYDSINVVFGGGTKLTVL

SEQ ID NO: 27531 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattggggaataaatatgattactggtatcagcagaagccaggccagtcccctgtgctggtcatctatcaagatagaaagcggccctcagggatccctgagcgattctctggctccaactctgggaacacagccaccctgaccatcagcgggacccaggctatggatgaggctgactattactgtcaggcgtgggacaacagcactgtggtattcggcggagggaccaaactgaccgtccta

SEQ ID NO: 27532 - protein, 106 aa, Artificial Sequence
  Description of Artificial Sequence: Synthetic polypeptide
SYELTQPPSVSVSPGQTASITCSGDKLGNKYDYWYQQKPGQSPVLVIYQDRKRPSGIPERFSGSNSGNTATLTISGTQAMDEADYYCQAWDNSTVVFGGGTKLTVL

SEQ ID NO: 27533 - DNA, 318 bp, Artificial Sequence
  Description of Artificial Sequence: Synthetic polynucleotide
tcctatgacctgactcagccaccctcagtgaccgtgtccccaggacagacagccagcatcacctgctctggagataaattggggaataaatatgcttgctggtatcagcagaagccaggccagtcccctgtggtggtcatctatcaagataggaagcggccctcagggatccctgagcgattctctggctccaactctgggaacacagccactctgaccatcagcgggacccaggctatggatgaggctgactattactgtcaggcgtgggacatcaacactgcggtattcggcggagggaccaagctgaccgtccta

SEQ ID NO: 27534 - protein, 106 aa, Artificial Sequence
  Description of Artificial Sequence: Synthetic polypeptide
SYDLTQPPSVTVSPGQTASITCSGDKLGNKYACWYQQKPGQSPVVVIYQDRKRPSGIPERFSGSNSGNTATLTISGTQAMDEADYYCQAWDINTAVFGGGTKLTVL

SEQ ID NO: 27535 - DNA, 318 bp, Artificial Sequence
  Description of Artificial Sequence: Synthetic polynucleotide
tcctatgaactgactcagccaccctcagtttccgtgtccccaggacagacagccagcatcacctgctctggagataaattggggtataaatatgcttggtggtatcagcagaagccaggccagtcccctgtgctggtcatctttgaagataggaagcggccctcagggatccctgagcgattctctggctccaactctgggaacacagccactctgaccatcagcgggacccaggctatggatgaggctgactattactgtcaggcgtgggacaacagcactgtggtattcggcggagggaccaggctgaccgtccta

SEQ ID NO: 27536 - protein, 106 aa, Artificial Sequence
  Description of Artificial Sequence: Synthetic polypeptide
SYELTQPPSVSVSPGQTASITCSGDKLGYKYAWWYQQKPGQSPVLVIFEDRKRPSGIPERFSGSNSGNTATLTISGTQAMDEADYYCQAWDNSTVVFGGGTRLTVL

SEQ ID NO: 27537 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgttggtcatctatcaagatagcaagcggccctcagggatccctgagcgattctctggctccaactctgggaacacagccactctgaccatcagcgggacccaggctatggatgaggctgactattactgtcaggcgtgggacaacagcactgtggtattcggcggagggaccaagctgaccgtccta

SEQ ID NO: 27538 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDNSTVVFGGGTKLTVL

SEQ ID NO: 27539 - DNA, 318 bp, Artificial Sequence; identical to SEQ ID NO: 27531
  Description of Artificial Sequence: Synthetic polynucleotide

SEQ ID NO: 27540 - protein, 106 aa, Artificial Sequence; identical to SEQ ID NO: 27532
  Description of Artificial Sequence: Synthetic polypeptide

SEQ ID NO: 27541 - DNA, 318 bp, Artificial Sequence
  Description of Artificial Sequence: Synthetic polynucleotide
tcctatgagctgactcagccaccctcagtgtccgtgtccccaggacaggcagccagcatcacctgctctggagataaattgggggataaatatgcttggtggtatcagcagaagccaggccagtcccctgtgctggtcatctatgaagataggaagcggccctcagggatccctgagcgattctctggctccaactctgggaacacagccactctgaccatcagcgggacccaggctatggatgaggctgactattactgtcaggcgtgggacaacagcactgtggtattcggcggagggaccaagctgaccgtccta

SEQ ID NO: 27542 - protein, 106 aa, Artificial Sequence
  Description of Artificial Sequence: Synthetic polypeptide
SYELTQPPSVSVSPGQAASITCSGDKLGDKYAWWYQQKPGQSPVLVIYEDRKRPSGIPERFSGSNSGNTATLTISGTQAMDEADYYCQAWDNSTVVFGGGTKLTVL

SEQ ID NO: 27543 - DNA, 318 bp, Artificial Sequence
  Description of Artificial Sequence: Synthetic polynucleotide
tcctatgagctgactcagccaccctcagtgtccgtgtctccaggacagacagccagcatcacctgctctggagataaattgggggataaatatgcttactggtatcagcagaaaccaggccagtcccctgtggtggtcatctatcaagataggaagcggccctcagggatccctgagcgattctctggctccaactctgggaacacagccactctgaccatcagcgggacccaggctatggatgaggctgactattactgtcaggcgtgggtcaacagcactgtggtattcggcggagggaccaagctgaccgtccta

SEQ ID NO: 27544 - protein, 106 aa, Artificial Sequence
  Description of Artificial Sequence: Synthetic polypeptide
SYELTQPPSVSVSPGQTASITCSGDKLGDKYAYWYQQKPGQSPVVVIYQDRKRPSGIPERFSGSNSGNTATLTISGTQAMDEADYYCQAWVNSTVVFGGGTKLTVL

SEQ ID NO: 27545 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttggtggtatcagcagaggccaggccagtcccctgtgctggtcatctatgaagataggaagcggccctcagggatccctgagcgattctctggctccaactctgggaacacagccactctgaccatcagcgggacccaggctatggatgaggctgactattactgtcaggcgtgggacaacagcactgtggtattcggcggagggaccaagctgaccgtccta

SEQ ID NO: 27546 - protein, 106 aa, Artificial Sequence
  Description of Artificial Sequence: Synthetic polypeptide
SYELTQPPSVSVSPGQTASITCSGDKLGDKYAWWYQQRPGQSPVLVIYEDRKRPSGIPERFSGSNSGNTATLTISGTQAMDEADYYCQAWDNSTVVFGGGTKLTVL

SEQ ID NO: 27547 - DNA, 318 bp, Artificial Sequence; identical to SEQ ID NO: 27521
  Description of Artificial Sequence: Synthetic polynucleotide

SEQ ID NO: 27548 - protein, 106 aa, Artificial Sequence; identical to SEQ ID NO: 27518
  Description of Artificial Sequence: Synthetic polypeptide

SEQ ID NO: 27549 - DNA, 330 bp, Artificial Sequence
  Description of Artificial Sequence: Synthetic polynucleotide
cagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacaacacaaacactcgctcttctggggtccctgatcgcttctctggctccatccttgggaacaaagctgccctcaccatcacgggggcccaggcagatgatgaatctgattattactgtgttctatatatgggtagtgccatttgggtgttcggcggagggaccaagttgaccgtccta

SEQ ID NO: 27550 - protein, 110 aa, Artificial Sequence
  Description of Artificial Sequence: Synthetic polypeptide
QTVVTQEPSFSVSPGGTVTLTCGLSSGSVSTSYYPSWYQQTPGQAPRTLIYNTNTRSSGVPDRFSGSILGNKAALTITGAQADDESDYYCVLYMGSAIWVFGGGTKLTVL

SEQ ID NO: 27551 - DNA, 318 bp, Artificial Sequence
  Description of Artificial Sequence: Synthetic polynucleotide
tcctatgacctgactcagccaccctcagtgtccgtgtccccaggacagacagccagcatcacctgctctggagataaattggggaataaatatgcttgctggtatcagcagaagccaggccagtcccctgtggtggtcatctatcaagatatgaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 27552 - protein, 106 aa, Artificial Sequence
  Description of Artificial Sequence: Synthetic polypeptide
SYDLTQPPSVSVSPGQTASITCSGDKLGNKYACWYQQKPGQSPVVVIYQDMKRPSGIPERFSGSNSGNTATLTISGTQAMDEADYYCQAWDSSTAVFGGGTKLTVL

SEQ ID NO: 27553 - DNA, 315 bp, Artificial Sequence
  Description of Artificial Sequence: Synthetic polynucleotide
ccctatgagctgaatcagacaccctcagtgtccgtgtccccaggacagacagccagcatcacctgctctggagatagattggggactaaatttgcttgctggtatcagcagaagccaggccagtcccctgtgctggtcatttatcaagatagcaagcggccctcagggatccctgagcgattctctggctccaactctgggaacacagccactctgaccatcagcgggacccaggctatggatgaggctgactattactgtcaggcgtgggacagcagcactgtattcggcggagggaccaagctgaccgtccta

SEQ ID NO: 27554 - protein, 105 aa, Artificial Sequence
  Description of Artificial Sequence: Synthetic polypeptide
PYELNQTPSVSVSPGQTASITCSGDRLGTKFACWYQQKPGQSPVLVIYQDSKRPSGIPERFSGSNSGNTATLTISGTQAMDEADYYCQAWDSSTVFGGGTKLTVL

SEQ ID NO: 27555 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggtaataaatatgtttgttggtatcagcagaagccaggccagtcccctgtgctggtcatctatcaagataacaggcggccctcagggatccctgagcgattctctggctccaactctgggaacacagccactctgaccatcagcgggacccaggctatggatgaggctgactattactgtcaggcgtgggacagcagtcctgtgatattcggcggagggaccaaactgaccgtccta

SEQ ID NO: 27556 - protein, 106 aa, Artificial Sequence
  Description of Artificial Sequence: Synthetic polypeptide
SYELTQPPSVSVSPGQTASITCSGDKLGNKYVCWYQQKPGQSPVLVIYQDNRRPSGIPERFSGSNSGNTATLTISGTQAMDEADYYCQAWDSSPVIFGGGTKLTVL

SEQ ID NO: 27557 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagatagattgggggataaatatgcttgctggtatcagcagaagccaggccagtcccctgtactggtcatctatcaagataggaagcggccctcagggatccctgagcgattctctggctccaactctgggaacacagccactctgaccatcagcgggacccaggctatggatgaggctgactattactgtcaggcgtgggacagcagtactgcggtattcggcggagggaccaagctgaccgtccta

SEQ ID NO: 27558 - protein, 106 aa, Artificial Sequence
  Description of Artificial Sequence: Synthetic polypeptide
SYELTQPPSVSVSPGQTASITCSGDRLGDKYACWYQQKPGQSPVLVIYQDRKRPSGIPERFSGSNSGNTATLTISGTQAMDEADYYCQAWDSSTAVFGGGTKLTVL

SEQ ID NO: 27559 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactgaaacagtcaccagtggttcttatccgaactggttccagcagaaacctggacaagcacccagggcactgatttatagtacaagcaacaaacactcctggacccctgcccggttctcaggctccctccttgggggcaaagctgccctgacactgtcagatgtgcagcctgaggacgaggctgagtattactgcctgctctactatggtggtgctcaactggtattcggcggagggaccaagctgaccgtccta

SEQ ID NO: 27560 - protein, 110 aa, Artificial Sequence
  Description of Artificial Sequence: Synthetic polypeptide
QTVVTQEPSLTVSPGGTVTLTCASSTETVTSGSYPNWFQQKPGQAPRALIYSTSNKHSWTPARFSGSLLGGKAALTLSDVQPEDEAEYYCLLYYGGAQLVFGGGTKLTVL

SEQ ID NO: 27561 - DNA, 318 bp, Artificial Sequence
  Description of Artificial Sequence: Synthetic polynucleotide
tcttatgagttgactcagccaccctcagagtctgtgtccccaggacagacagccagcatcacgtgctcaggagataaattggggaataaatatgtttcctggtatcagcagaagccaggccagtcccctgtgctggtcatctatcaagataacaggcggccgtcagggatccctgagcgattttctggctccaactctgggagcacagccactttgaccatcagcgggacccaggctatggatgaggctgactattactgtcaggcgtgggacagcagccctgtgatattcggcggagggaccaagctgaccgtccta

SEQ ID NO: 27562 - protein, 106 aa, Artificial Sequence
  Description of Artificial Sequence: Synthetic polypeptide
SYELTQPPSESVSPGQTASITCSGDKLGNKYVSWYQQKPGQSPVLVIYQDNRRPSGIPERFSGSNSGSTATLTISGTQAMDEADYYCQAWDSSPVIFGGGTKLTVL

SEQ ID NO: 27563 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcaccactgtggtattcggcggagggaccaagctgaccgtccta

SEQ ID NO: 27564 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSTTVVFGGGTKLTVL

SEQ ID NO: 27565 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttactttccaaactggttccagcagaaacctggacaagcacccagggcactgatttatagtacagacaacaaacactcctggacccctgcccggttctcaggctccctccttgggggcaaagctgccctgacactgtcaggtgtgcagcctgaggacgaggctgagtattactgcctcctctactatggtggtgctcagctgatgttcggcggagggaccaagctgaccgtccta

SEQ ID NO: 27566 - protein, 110 aa, Artificial Sequence
  Description of Artificial Sequence: Synthetic polypeptide
QTVVTQEPSLTVSPGGTVTLTCASSTGAVTSGYFPNWFQQKPGQAPRALIYSTDNKHSWTPARFSGSLLGGKAALTLSGVQPEDEAEYYCLLYYGGAQLMFGGGTKLTVL

SEQ ID NO: 27567 - DNA, 318 bp, Artificial Sequence
  Description of Artificial Sequence: Synthetic polynucleotide
tcctatgagctgactcagccaccctcagtgtccgtgtccccaggacagacagccagcatcacctgctcaggagataaattggggaataaatatgtttcctggtatcagcagaagccaggccagtcccctgtgctggtcatctatcaagataacaggcggccctcagggatccctgagcgattctctggctccaactctgggagcacagccactctgaccatcagcgggacccaggctatggatgaggctgactattactgtcaggcgtgggacagcagccctgtgatattcggcggagggaccaagctgaccgtccta

SEQ ID NO: 27568 - protein, 106 aa, Artificial Sequence
  Description of Artificial Sequence: Synthetic polypeptide
SYELTQPPSVSVSPGQTASITCSGDKLGNKYVSWYQQKPGQSPVLVIYQDNRRPSGIPERFSGSNSGSTATLTISGTQAMDEADYYCQAWDSSPVIFGGGTKLTVL

SEQ ID NO: 27569 - DNA, 318 bp, Artificial Sequence
  Description of Artificial Sequence: Synthetic polynucleotide
tcctatgagctgactcagccaccctcagtgtccgtgtccccaggacagacagccaacatcacctgctctggagataaattggggaataaatatgtttgctggtatcaacagaagccaggccagtcccctgtgttggtcatctatcaagataacaggcggccctcagggatccctgagcgattctctggctccaactctgggaacacagccactctgaccatcagcgggacccaggctatggatgaggctgactattactgtcaggcgtgggacagcagccctgtgatattcggcggagggaccaagctgaccgtccta

SEQ ID NO: 27570 - protein, 106 aa, Artificial Sequence
  Description of Artificial Sequence: Synthetic polypeptide
SYELTQPPSVSVSPGQTANITCSGDKLGNKYVCWYQQKPGQSPVLVIYQDNRRPSGIPERFSGSNSGNTATLTISGTQAMDEADYYCQAWDSSPVIFGGGTKLTVL

SEQ ID NO: 27571 - DNA, 315 bp, Artificial Sequence; identical to SEQ ID NO: 27553
  Description of Artificial Sequence: Synthetic polynucleotide

SEQ ID NO: 27572 - protein, 105 aa, Artificial Sequence; identical to SEQ ID NO: 27554
  Description of Artificial Sequence: Synthetic polypeptide

SEQ ID NO: 27573 - DNA, 318 bp, Artificial Sequence
  Description of Artificial Sequence: Synthetic polynucleotide
tcctatgagctgactcagccaccctcagtgtctgtgtccccaggacagacagtcagcatcacctgctctggagataaattggggaataaatatgtttcctggtatcagcagaagccaggccagtcccctgtgctggtcatctatcaagataacaggcggccgtcagggatccctgagcgattctctggctccaactctgggagcacagccactctgaccatcagcgggacccaggctatggatgaggctgactattactgtcaggcgtgggacagcacccctgtgatattcggcggagggaccaagctgaccgtccta

SEQ ID NO: 27574 - protein, 106 aa, Artificial Sequence
  Description of Artificial Sequence: Synthetic polypeptide
SYELTQPPSVSVSPGQTVSITCSGDKLGNKYVSWYQQKPGQSPVLVIYQDNRRPSGIPERFSGSNSGSTATLTISGTQAMDEADYYCQAWDSTPVIFGGGTKLTVL

SEQ ID NO: 27575 - DNA, 318 bp, Artificial Sequence
  Description of Artificial Sequence: Synthetic polynucleotide
tcctatgcgatgactcagccaccctcaatgtccgtgtccccaggacagacagccagcatcacctgctctggaaataaattggggaatagatatgcttgctggtatcagcagaagccaggccagtcccctgtgctggtcatctatcaagatagcaagcggccctcagggatccctgagcgattctctggctccaactctgggaacatagccactctgaccatcagcgggacccaggctatggatgaggctgactattactgtcaggcgtgggacagcagcactgtggtattcggcggagggaccaagctgaccgtccta

SEQ ID NO: 27576 - protein, 106 aa, Artificial Sequence
  Description of Artificial Sequence: Synthetic polypeptide
SYAMTQPPSMSVSPGQTASITCSGNKLGNRYACWYQQKPGQSPVLVIYQDSKRPSGIPERFSGSNSGNIATLTISGTQAMDEADYYCQAWDSSTVVFGGGTKLTVL

SEQ ID NO: 27577 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgtttgctggtatcagcagaagccaggccagtcccctgtgttggtcatctatcaagataggaagcggccctcagggatccctgagcgattctctggctccaactctgggaacacagccactctgaccatcagcgggacccaggctatggatgaggctgactattactgtcaggcgtggcacagcagcactgtggtattcggcggagggaccaagctgaccgtccta

SEQ ID NO: 27578 - protein, 106 aa, Artificial Sequence; identical to SEQ ID NO: 27358
  Description of Artificial Sequence: Synthetic polypeptide

SEQ ID NO: 27579 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataagaagcggccctcagggatccctgagcgattctctggctccaactctgggaacacagccactctgaccatcagcgggacccaggttatggatgaggctgactattactgtcaggcgtgggacatcagaactgtggtattcggcggagggaccaagctgaccgtccta

SEQ ID NO: 27580 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDKKRPSGIPERFSGSNSGNTATLTISGTQVMDEADYYCQAWDIRTVVFGGGTKLTVL

SEQ ID NO: 27581 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggagaaatatgcttgctggtatcagcagaagtcaggccagtcccctgtgttggtcatctatcaagatagaaagcggccctcagggatccctgagcgattctctggctccaactctgggaacacagccactctgaccatcagcgggacccaggctatggatgaggctgactattactgtcaggcgtgggacagtagaactgcggtattcggcggagggaccaagctgaccgtccta

SEQ ID NO: 27582 - protein, 106 aa, Artificial Sequence
  Description of Artificial Sequence: Synthetic polypeptide
SYELTQPPSVSVSPGQTASITCSGDKLGEKYACWYQQKSGQSPVLVIYQDRKRPSGIPERFSGSNSGNTATLTISGTQAMDEADYYCQAWDSRTAVFGGGTKLTVL

SEQ ID NO: 27583 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgttggtatcagcagaagccaggccagtcccctgtgttggtcatctatcaagataagaaacggccctcagggatccctgagcgattctctggctccaactctggaaacacagccactctgaccatcagcgggacccaggctatggatgaggctgactattactgtcaggcgtgggacaacagcactgctgtggtattcggcggagggaccaaactgaccgtccta

SEQ ID NO: 27584 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDKKRPSGIPERFSGSNSGNTATLTISGTQAMDEADYYCQAWDNSTAVVFGGGTKLTVL

SEQ ID NO: 27585 - DNA, 330 bp, Artificial Sequence
  Description of Artificial Sequence: Synthetic polynucleotide
cagactgtggtgacccaggagccatcgttctcagtgtcccctggagggacagtcacactcacttgtggcttgagctctggctcagtctctactactttctaccccagctggtaccagcagaccccaggccaggctccacgcacgctcatctacaacacaaacactcgctcttctggggtccctgatcgcttctctggctccatccttgggaacaaagctgccctcaccatcacgggggcccaggcagatgatgaatctgattattactgtgtgctttatatgggtagtggcatttgggtgttcggcggagggaccaagctgaccgtccta

SEQ ID NO: 27586 - protein, 110 aa, Artificial Sequence
  Description of Artificial Sequence: Synthetic polypeptide
QTVVTQEPSFSVSPGGTVTLTCGLSSGSVSTTFYPSWYQQTPGQAPRTLIYNTNTRSSGVPDRFSGSILGNKAALTITGAQADDESDYYCVLYMGSGIWVFGGGTKLTVL

SEQ ID NO: 27587 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatttgcttgctggtatcagcagaagccaggccagtcccctgtgctggtcatctatgaagataggaagcggccctcagggatccctgagcgattctctggctccaactctgggaacacagccactctgaccatcagcgggacccaggctatggatgaggctgactattactgtcaggcgtgggacagccgcactgtggtattcggcggagggacccagctgaccgtccta

SEQ ID NO: 27588 - protein, 106 aa, Artificial Sequence
  Description of Artificial Sequence: Synthetic polypeptide
SYELTQPPSVSVSPGQTASITCSGDKLGDKFACWYQQKPGQSPVLVIYEDRKRPSGIPERFSGSNSGNTATLTISGTQAMDEADYYCQAWDSRTVVFGGGTQLTVL

SEQ ID NO: 27589 - DNA, 318 bp, Artificial Sequence
  Description of Artificial Sequence: Synthetic polynucleotide
tcctatgagctgactcagacaccctcagtgtccgtgtccccaggacagacagccagcatcacctgctctggagataaattgggggataaatatgcttgctggtatcagcagaagccaggccagtcccctgtgctggtcatctatgaagataggaagcggccctcagggatccctgaccgattctctggctccaactctgggaacacagccactctgaccatcagcgggacccaggctatggatgaggctgactattactgtcaggcgtgggacagcaggaaagtggtattcggcggagggaccaagctgaccgtccta

SEQ ID NO: 27590 - protein, 106 aa, Artificial Sequence
  Description of Artificial Sequence: Synthetic polypeptide
SYELTQTPSVSVSPGQTASITCSGDKLGDKYACWYQQKPGQSPVLVIYEDRKRPSGIPDRFSGSNSGNTATLTISGTQAMDEADYYCQAWDSRKVVFGGGTKLTVL

SEQ ID NO: 27591 - DNA, 315 bp, Artificial Sequence
  Description of Artificial Sequence: Synthetic polynucleotide
tcctatgagctgactcagccaccctcagtgtccgtgtccccaggacagacagccagcatcacctgctctggagataaattggggcataaatttgtttgctggtatcagcagaagccaggccagtcccctgtgttggtcatctatcaagatcgcaagcggccctcagggatccctgagcgattctctggctccaactctgggaacacagccactctgaccatcagcgggacccaggctatggatgaggctgactattactgtcaggcgtgggacagcagcacggtattcggcggagggaccaagctgaccgtccta

SEQ ID NO: 27592 - protein, 105 aa, Artificial Sequence
  Description of Artificial Sequence: Synthetic polypeptide
SYELTQPPSVSVSPGQTASITCSGDKLGHKFVCWYQQKPGQSPVLVIYQDRKRPSGIPERFSGSNSGNTATLTISGTQAMDEADYYCQAWDSSTVFGGGTKLTVL

SEQ ID NO: 27593 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaaatgggggaaaaatatgcttgctggtatcagcagaagccaggccagtcccctgtgctggtcatttatcaagatagaaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 27594 - protein, 106 aa, Artificial Sequence
  Description of Artificial Sequence: Synthetic polypeptide
SYELTQPPSVSVSPGQTASITCSGDKMGEKYACWYQQKPGQSPVLVIYQDRKRPSGIPERFSGSNSGNTATLTISGTQAMDEADYYCQAWDSSTAVFGGGTKLTVL

SEQ ID NO: 27595 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttcctatccaaactggttccagcagaaacctggacaagcacccagggcactgatttacagtacaagtaacaaacactcctggacccctgcccggttctcaggctccctccttgggggcaaagctgccctgacactgtcaggtgtgcagcctgaggacgaggctgactattactgcctgctctactatggtggtgctcaggtggcattcggcggagggaccaagttgaccgtccta

SEQ ID NO: 27596 - protein, 110 aa, Artificial Sequence
  Description of Artificial Sequence: Synthetic polypeptide
QTVVTQEPSLTVSPGGTVTLTCASSTGAVTSGSYPNWFQQKPGQAPRALIYSTSNKHSWTPARFSGSLLGGKAALTLSGVQPEDEADYYCLLYYGGAQVAFGGGTKLTVL

SEQ ID NO: 27597 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggagtaattatgtttcctggtaccaacagctcccaggaacagcccccaaagtcctcatttatgacaataataagcgaccctcagggattcctgaccgattctctggctccaagtctggcacgtcagccaccctgggcatcaccggactccagactggggacgaggccgattattactgcggaacatgggatagcagactgaatgttggggtattcggcggagggaccaagctgaccgtccta

SEQ ID NO: 27598 - protein, 110 aa, Artificial Sequence
  Description of Artificial Sequence: Synthetic polypeptide
QSVLTQPPSVSAAPGQKVTISCSGSSSNIGSNYVSWYQQLPGTAPKVLIYDNNKRPSGIPDRFSGSKSGTSATLGITGLQTGDEADYYCGTWDSRLNVGVFGGGTKLTVL

SEQ ID NO: 27599 - DNA, 318 bp, Artificial Sequence
  Description of Artificial Sequence: Synthetic polynucleotide
tcctatgagttgactcagccaccctcagtgtccgtgtccccaggacagacagccagcatcacctgctctggagataaattgggggatagatttgcttactggtatcagcagaagccaggccagtcccctgtactggtcatctatcaagatagcaagcggccctcagggatccctgagcgattctctggctccaactctgggaacacagccactctgaccatcagcgggacccaggctatggatgaggctgactattactgtaaggcgtgggacagcagcactgtggtattcggcggagggaccaagctgaccgtccta

SEQ ID NO: 27600 - protein, 106 aa, Artificial Sequence
  Description of Artificial Sequence: Synthetic polypeptide
SYELTQPPSVSVSPGQTASITCSGDKLGDRFAYWYQQKPGQSPVLVIYQDSKRPSGIPERFSGSNSGNTATLTISGTQAMDEADYYCKAWDSSTVVFGGGTKLTVL

SEQ ID NO: 27601 - DNA, 327 bp, Artificial Sequence
  Description of Artificial Sequence: Synthetic polynucleotide
tcttctgagctgactcaggaccctgctgtgtctgtggccttgggacagacagtcaggatcacatgccaaggagacaaactcagaacctattatgcaagctggtaccagcagaagccaggacaggcccctgtacttgtcgtctatggaaaaaacaaccggccctcagggatcccagaccgattctctggctccagctcaggaaacacagcttccttgaccatcactggggctcaggcggaagatgaggctgactattactgtaactcccgggacagcagtggtaaccatcttgtactattcggcggagggaccaagctgaccgtccta

SEQ ID NO: 27602 - protein, 109 aa, Artificial Sequence
  Description of Artificial Sequence: Synthetic polypeptide
SSELTQDPAVSVALGQTVRITCQGDKLRTYYASWYQQKPGQAPVLVVYGKNNRPSGIPDRFSGSSSGNTASLTITGAQAEDEADYYCNSRDSSGNHLVLFGGGTKLTVL

SEQ ID NO: 27603 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattggaaataattatgtatcctggtaccagcagctcccaggaacagcccccaaactcctcctttatgacagtaataagcgaccctcagggattcctggccgattctctggctccaagtctggcacgtcagccaccctgggcatcaccggcctccagactggggacgaggccgattattactgcggaacatgggatagcagcctgagtactgtggtattcggcggagggaccaagctgaccgtccta

SEQ ID NO: 27604 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLLYDSNKRPSGIPGRFSGSKSGTSATLGITGLQTGDEADYYCGTWDSSLSTVVFGGGTKLTVL

SEQ ID NO: 27605 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcatctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggggttttcggcggagggaccaagctgaccgtccta

SEQ ID NO: 27606 - protein, 110 aa, Artificial Sequence
  Description of Artificial Sequence: Synthetic polypeptide
QSVLTQPPSVSAAPGQKVTISCSGSSSNIGNNYVSWYQHLPGTAPKLLIYDNNKRPSGIPDRFSGSKSGTSATLGITGLQTGDEADYYCGTWDSSLSAGVFGGGTKLTVL

SEQ ID NO: 27607 - DNA, 327 bp, Artificial Sequence
  Description of Artificial Sequence: Synthetic polynucleotide
tcttctgagctgactcaggaccctgctgtgtctgtggccttgggacagacagtcaggatcacatgccaaggagacaccctcagaccctattatgtaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatcttgtggtattcggcggagggaccaagctgaccgtccta

SEQ ID NO: 27608 - protein, 109 aa, Artificial Sequence
  Description of Artificial Sequence: Synthetic polypeptide
SSELTQDPAVSVALGQTVRITCQGDTLRPYYVSWYQQKPGQAPVLVIYGKNNRPSGIPDRFSGSSSGNTASLTITGAQAEDEADYYCNSRDSSGNHLVVFGGGTKLTVL

SEQ ID NO: 27609 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaggcagctccaacattgggaataattatgtatcctggtttcagcagttcccaggaacagcccccaaattcctcatttatgacaataataagcgaccctcagggattcctgaccgattctctggctccaagtctggcacgtcagccaccctgggcatcaccggactccagactggtgacgaggccgattattactgcggaacatgggatcgcaccctgagtgattgggtattcggcggagggaccaagctgaccgtccta

SEQ ID NO: 27610 - protein, 110 aa, Artificial Sequence
  Description of Artificial Sequence: Synthetic polypeptide
QSVLTQPPSVSAAPGQKVTISCSGGSSNIGNNYVSWFQQFPGTAPKFLIYDNNKRPSGIPDRFSGSKSGTSATLGITGLQTGDEADYYCGTWDRTLSDWVFGGGTKLTVL

SEQ ID NO: 27611 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggagtaattatgtttcctggtaccaacagctcccaggaacagcccccaaagtcctcatttatgacaataataagcgaccctcagggattcctgaccgattctctggctccaagtctggcacgtcagccaccctgggcatcaccggactccagactggggacgaggccgattattactgcggaacatgggatggcagactgaatgttggggtattcggcggagggaccaagctgaccgtccta

SEQ ID NO: 27612 - protein, 110 aa, Artificial Sequence
  Description of Artificial Sequence: Synthetic polypeptide
QSVLTQPPSVSAAPGQKVTISCSGSSSNIGSNYVSWYQQLPGTAPKVLIYDNNKRPSGIPDRFSGSKSGTSATLGITGLQTGDEADYYCGTWDGRLNVGVFGGGTKLTVL

SEQ ID NO: 27613 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaatcattatgtctcctggtaccagcagcttccaggaacagcccccaaactcctcatttatgacagtagtaagcgaccctcagagattcctgaccgattctctggctccaagtctggcacgtccgccaccctgggcatcaccggactccagactggggacgaggccgattattactgcggaacatgggatagtagtctgagtactgtggtattcggcggagggaccaagctgaccgtccta

SEQ ID NO: 27614 - protein, 110 aa, Artificial Sequence
  Description of Artificial Sequence: Synthetic polypeptide
QSVLTQPPSVSAAPGQKVTISCSGSSSNIGNHYVSWYQQLPGTAPKLLIYDSSKRPSEIPDRFSGSKSGTSATLGITGLQTGDEADYYCGTWDSSLSTVVFGGGTKLTVL

SEQ ID NO: 27615 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggatagatttgcttactggtatcagcagaagccaggccagtcccctgtgctggtcatctatcaagataacaagcggccctcagggatccctgagcgattctctggctccaactctgggaacacagcctctctgaccatcagcgggacccaggctatggatgaggctgactattactgtcaggcgtgggacagcagcactgtggtattcggcggagggaccaggctgaccgtccta

SEQ ID NO: 27616 - protein, 106 aa, Artificial Sequence
  Description of Artificial Sequence: Synthetic polypeptide
SYELTQPPSVSVSPGQTASITCSGDKLGDRFAYWYQQKPGQSPVLVIYQDNKRPSGIPERFSGSNSGNTASLTISGTQAMDEADYYCQAWDSSTVVFGGGTRLTVL

SEQ ID NO: 27617 - DNA, 327 bp, Artificial Sequence
  Description of Artificial Sequence: Synthetic polynucleotide
tcttctgagctgactcaggaccctgctgtgtctgtggccttgggacagacagtcaggatcacatgccaaggagacagcctcagaccctattatgcaagctggtaccagcagaagccaggacaggcccctgtacttgtcatctatggtaaaaacaaccggccctcagggatcccagaccgattctctggctccagttcaggaaacacagcttccttgaccatcactgaggctcaggcggaagatgaggctgactattactgtaactcccgggacagcagtggtaaccatcttgtggtattcggcggagggaccaagctgaccgtccta

SEQ ID NO: 27618 - protein, 109 aa, Artificial Sequence
  Description of Artificial Sequence: Synthetic polypeptide
SSELTQDPAVSVALGQTVRITCQGDSLRPYYASWYQQKPGQAPVLVIYGKNNRPSGIPDRFSGSSSGNTASLTITEAQAEDEADYYCNSRDSSGNHLVVFGGGTKLTVL

SEQ ID NO: 27619 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggagtaattatgtttcctggtaccaacagctcccaggaacagtccccaaagtcctcatttatgacaataataagcgaccctcagggattcctgaccgattctctggctccaagtctggcacgtcagccaccctgggcatcaccggactccagactggggacgaggccgattattactgcggaacatgggatagcagactgaatgttggggtattcggcggagggaccaagctgaccgtccta

SEQ ID NO: 27620 - protein, 110 aa, Artificial Sequence
  Description of Artificial Sequence: Synthetic polypeptide
QSVLTQPPSVSAAPGQKVTISCSGSSSNIGSNYVSWYQQLPGTVPKVLIYDNNKRPSGIPDRFSGSKSGTSATLGITGLQTGDEADYYCGTWDSRLNVGVFGGGTKLTVL

SEQ ID NO: 27621 - DNA, 330 bp, Artificial Sequence
  Description of Artificial Sequence: Synthetic polynucleotide
cagactgtggtgactcaggagccctcactgactgtgtccccaggagggacagtcactctcacttgtgtttttagcactggagcagtcaccagtggttcctttccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgactattactgcctgctctactgtggtggtgctcagctggtgttcggcggagggaccaagctgaccgtccta

SEQ ID NO: 27622 - protein, 110 aa, Artificial Sequence
  Description of Artificial Sequence: Synthetic polypeptide
QTVVTQEPSLTVSPGGTVTLTCVFSTGAVTSGSFPNWFQQKPGQAPRALIYSTSNKHSWTPARFSGSLLGGKAALTLSGVQPEDEADYYCLLYCGGAQLVFGGGTKLTVL

SEQ ID NO: 27623 - DNA, 330 bp, Artificial Sequence
  Description of Artificial Sequence: Synthetic polynucleotide
cagtctgtgttgacgcagccgccctcagtgtctgcggccccaggacagagggtcaccatctcctgctctggaagcagctccaaccttggaaataattttgtatcctggtaccagcagttcccaggaacagcccccaaactcctcatttatgacaattataagcgaccctcagggattcctgaccgattctctgtctccaagtctggcacgtcagccaccctgggcatcaccggactccagactggggacgaggccgattattactgcggaacatgggatagcagcctgaatactggggtattcggcggagggaccaagctgaccgtccta

SEQ ID NO: 27624 - protein, 110 aa, Artificial Sequence
  Description of Artificial Sequence: Synthetic polypeptide
QSVLTQPPSVSAAPGQRVTISCSGSSSNLGNNFVSWYQQFPGTAPKLLIYDNYKRPSGIPDRFSVSKSGTSATLGITGLQTGDEADYYCGTWDSSLNTGVFGGGTKLTVL

SEQ ID NO: 27625 - DNA, 330 bp, Artificial Sequence
  Description of Artificial Sequence: Synthetic polynucleotide
cagactgtggtgactcaggagccctcactgactgtgtccccaggagggacagtcactctcacttgtgttcttagcactggagcagtcaccagtggttcctttccaaactggttccagcagaaacctggacaagcacccagggcactgatttatagtacaagcaacaaacactcctggacccctgcccggttttcaggctccctcctggggggcaaagctgccctgacactgtcaggtgtgcagcctgaggacgaggctgactattactgcatgctctactgtggtggtgctcagctggtgttcggcggagggaccaagctgaccgtccta

SEQ ID NO: 27626 - protein, 110 aa, Artificial Sequence
  Description of Artificial Sequence: Synthetic polypeptide
QTVVTQEPSLTVSPGGTVTLTCVLSTGAVTSGSFPNWFQQKPGQAPRALIYSTSNKHSWTPARFSGSLLGGKAALTLSGVQPEDEADYYCMLYCGGAQLVFGGGTKLTVL

SEQ ID NO: 27627 - DNA, 327 bp, Artificial Sequence
  Description of Artificial Sequence: Synthetic polynucleotide
tcttctgagctgactcaggaccctgctgtgtctgtggccttgggacagacagtcaggatcacatgccaaggagacaccctcagaccctattatgcaagttggtaccagcagaagccaggacaggcccctgtacttgtcatctatggtaaaaacaaccggccctcagggatctcagaccgattctctggctccagctcaggaaacacagcttccttgaccatcactggggctcaggcggaagatgaggctgactattactgtaactcccgggacagcagtggtaaccatcttgtggtattcggcggagggaccaagctgaccgtccta

SEQ ID NO: 27628 - protein, 109 aa, Artificial Sequence
  Description of Artificial Sequence: Synthetic polypeptide
SSELTQDPAVSVALGQTVRITCQGDTLRPYYASWYQQKPGQAPVLVIYGKNNRPSGISDRFSGSSSGNTASLTITGAQAEDEADYYCNSRDSSGNHLVVFGGGTKLTVL

SEQ ID NO: 27629 - DNA, 327 bp, Artificial Sequence
  Description of Artificial Sequence: Synthetic polynucleotide
tcttctgagctgactcaggaccctgctgtgtctgtggccttgggacagacagtcaggatcacatgccaaggagacagcctcagaccctattatgcaagctggtaccagcagaagccaggacaggcccctgtacttgtcatctatggtaaaaacaaccggccctcagggatcccagaccgattctctggctccagctcaggaaacacagcttccttgaccatcactgaggctcaggcggaagatgaggctgactattactgtaactcccgggacagctgtggtaaccatcttgtggtattcggcggagggaccaagctgaccgtccta

SEQ ID NO: 27630 - protein, 109 aa, Artificial Sequence
  Description of Artificial Sequence: Synthetic polypeptide
SSELTQDPAVSVALGQTVRITCQGDSLRPYYASWYQQKPGQAPVLVIYGKNNRPSGIPDRFSGSSSGNTASLTITEAQAEDEADYYCNSRDSCGNHLVVFGGGTKLTVL

SEQ ID NO: 27631 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacatcgggaataattatgtatcctggtaccagcagctcccaggaacagcccccaaactcctcatttatgacaataaaaagcgaccctcagggattcctgaccgattctctggctccaagtctggcacgtcagccaccctgggcatcaccggactccagactggggacgaggccgattattactgcggaacatgggatagcagcctgagtgtttgtgtcttcggaactgggaccaaggtcaccgtccta

SEQ ID NO: 27632 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNKKRPSGIPDRFSGSKSGTSATLGITGLQTGDEADYYCGTWDSSLSVCVFGTGTKVTVL

SEQ ID NO: 27633 - DNA, 345 bp, Artificial Sequence
  Description of Artificial Sequence: Synthetic polynucleotide
caggctgtgtcgactcggccgtcttccctctctgcatctcctggagcatcagccagtctcacctgcaccttacgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgctgtggtattcggcggagggaccaagctgaccgtccta

SEQ ID NO: 27634 - protein, 115 aa, Artificial Sequence
  Description of Artificial Sequence: Synthetic polypeptide
QAVSTRPSSLSASPGASASLTCTLRSGINVGTYRIYWYQQKPGSPPQYLLRYKSDSDKQQGSGVPSRFSGSKDASANAGILLISGLQSEDEADYYCMIWHSSAVVFGGGTKLTVL

SEQ ID NO: 27635 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtgcttactatccaaactggttgcagcagaaacctggacaagcacccaggacactgatttatagtacaaacaacaaacactcctggacccctgcccggttctcaggctccctccttgggggcaaagctgccctgacactgtcagatgtgcagcctgaggacgaggctgagtattactgcctgatcttctatggtggtgtacatgtgatatttggcggagggaccaagctgaccgtccta

SEQ ID NO: 27636 - protein, 110 aa, Artificial Sequence
  Description of Artificial Sequence: Synthetic polypeptide
QTVVTQEPSLTVSPGGTVTLTCASSTGAVTSAYYPNWLQQKPGQAPRTLIYSTNNKHSWTPARFSGSLLGGKAALTLSDVQPEDEAEYYCLIFYGGVHVIFGGGTKLTVL

SEQ ID NO: 27637 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcaaggattcctgaccgattctctggctccaagtctggcacgtcagccaccctgggcatcaccggactccagactggggacgaggccgattattactgcggaacatgggatagcagcctgagtgctggggtattcggcggagggaccaagctgaccgtccta

SEQ ID NO: 27638 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSRIPDRFSGSKSGTSATLGITGLQTGDEADYYCGTWDSSLSAGVFGGGTKLTVL

SEQ ID NO: 27639 - DNA, 330 bp, Artificial Sequence
  Description of Artificial Sequence: Synthetic polynucleotide
cagactgtggtgactcaggagccctcactgactgtgtccccaggagggacagtcactctcacctgtgctttcagcactggatcagtcaccagtggttcctatccaaactggttccagcagaaacctggacaagcacccagggcactgatttatagtacaaacaacaaacactcctggacccctgcccggttctcaggctccctccttgggggcaaagctgccctgacactgtcaggtgtgcagcgtgaggacgaggctgagtattactgcctgctatactatggtggtgctcagctggtgttcggcggagggaccaagctgaccgtccta

SEQ ID NO: 27640 - protein, 110 aa, Artificial Sequence
  Description of Artificial Sequence: Synthetic polypeptide
QTVVTQEPSLTVSPGGTVTLTCAFSTGSVTSGSYPNWFQQKPGQAPRALIYSTNNKHSWTPARFSGSLLGGKAALTLSGVQREDEAEYYCLLYYGGAQLVFGGGTKLTVL

SEQ ID NO: 27641 - DNA, 330 bp, Artificial Sequence
  Description of Artificial Sequence: Synthetic polynucleotide
cagtctgtgctgactcagccaccctcagcgtctgggacccccggacagagggtcaccatgtcttgttctggaagcagctccaacatcggaagtaatactgtaaactggtaccaacaattcccaggaacggcccccaaactcctcatctatggtaataagcagcggccctcaagggtccctgaccgattctctggctccaagtctggcacctcagcctccctggccatcagtgggctccagtctgaggatgagactgattattactgtgcagcgtgggatgacagcctgaatggttgggtgttcggcggagggaccaagctgaccgtccta

SEQ ID NO: 27642 - protein, 110 aa, Artificial Sequence
  Description of Artificial Sequence: Synthetic polypeptide
QSVLTQPPSASGTPGQRVTMSCSGSSSNIGSNTVNWYQQFPGTAPKLLIYGNKQRPSRVPDRFSGSKSGTSASLAISGLQSEDETDYYCAAWDDSLNGWVFGGGTKLTVL

SEQ ID NO: 27643 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggtaactatccacagtggttccagcagaaacctggacaagcacccagggcactgatttacagtacaaccaacagacattcctggacccctgcccggttttcaggctccctcctggggggcaaagctgccctgacactgtcaggtgtgcagcctgaggacgaggctgagtattactgcctgttctactatggtggtgctcaggtgatattcggcggagggaccaagctgaccgtccta

SEQ ID NO: 27644 - protein, 110 aa, Artificial Sequence
  Description of Artificial Sequence: Synthetic polypeptide
QTVVTQEPSLTVSPGGTVTLTCASSTGAVTSGNYPQWFQQKPGQAPRALIYSTTNRHSWTPARFSGSLLGGKAALTLSGVQPEDEAEYYCLFYYGGAQVIFGGGTKLTVL

SEQ ID NO: 27645 - DNA, 330 bp, Artificial Sequence
  Description of Artificial Sequence: Synthetic polynucleotide
cagactgtggtgactcaggaaccctcactgactgtgtccccaggagggacagtcactctcacctgtgctttcagcactggaacagtcaccagtggtttctatccaaactggttccagcagaaacctggacaagcacccagggcattgatttataatacaagcaacagacactcctggacccctgcccggttctcaggctccctccttgggggcatggctgccctgacactgtcaggtgtgcagcctgaggacgaggctgattattactgcctgctgtactatggtggtgctcagctgatgttcggcggagggaccaagctgaccgtccta

SEQ ID NO: 27646 - protein, 110 aa, Artificial Sequence
  Description of Artificial Sequence: Synthetic polypeptide
QTVVTQEPSLTVSPGGTVTLTCAFSTGTVTSGFYPNWFQQKPGQAPRALIYNTSNRHSWTPARFSGSLLGGMAALTLSGVQPEDEADYYCLLYYGGAQLMFGGGTKLTVL

SEQ ID NO: 27647 - DNA, 324 bp, Artificial Sequence
  Description of Artificial Sequence: Synthetic polynucleotide
tcttctgagctgactcaggaccctgctgtgtctgtggccttgggacagacagtcaggatcacatgccaaggagacagcctcagaagctattatgcaaactggtaccagcagaagccaggacaggcccctgtacttttcatctatgctaagaacaaccggccctcagggatcccagaccgattctctggctccaactcaggaaacacagcttccttgaccatcactggggctcaggcggaagatgaggctgactattactgtaattcccgggacagcagtggtaaccatctggtattcggcggagggaccaagctgaccgtccta

SEQ ID NO: 27648 - protein, 108 aa, Artificial Sequence
  Description of Artificial Sequence: Synthetic polypeptide
SSELTQDPAVSVALGQTVRITCQGDSLRSYYANWYQQKPGQAPVLFIYAKNNRPSGIPDRFSGSNSGNTASLTITGAQAEDEADYYCNSRDSSGNHLVFGGGTKLTVL

SEQ ID NO: 27649 - DNA, 318 bp, Artificial Sequence
  Description of Artificial Sequence: Synthetic polynucleotide
tcctatgaactgactcagccatcctcagtgtccgtgtccccaggacagacagccagcatcacctgctctggagataaattgggggatagatttgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 27650 - protein, 106 aa, Artificial Sequence
  Description of Artificial Sequence: Synthetic polypeptide
SYELTQPSSVSVSPGQTASITCSGDKLGDRFACWYQQKPGQSPVLVIYQDSKRPSGIPERFSGSNSGNTATLTISGTQAMDEADYYCQAWDSSTAVFGGGTKLTVL

SEQ ID NO: 27651 - DNA, 330 bp, Artificial Sequence
  Description of Artificial Sequence: Synthetic polynucleotide
cagtatgtgttgacgcagccgccatcagtgtctgcggccccaggacagaaggtcaccatctcctgcttcggaggcagctccaacattgggaataattatgtatcctggttccagcagttcccaggaacagcccccaaattcctcatttatgacaataataagcgaccctcagggattcttgaccgattatctggctccaagtctggcacgtcagccaccctggacatcaccggactccagaatggggacgaggccgattattactgcggaacatgggatcgcaccatgagtgattgggtattcggcggagggaccaagctgaccgtccta

SEQ ID NO: 27652 - protein, 110 aa, Artificial Sequence
  Description of Artificial Sequence: Synthetic polypeptide
QYVLTQPPSVSAAPGQKVTISCFGGSSNIGNNYVSWFQQFPGTAPKFLIYDNNKRPSGILDRLSGSKSGTSATLDITGLQNGDEADYYCGTWDRTMSDWVFGGGTKLTVL

SEQ ID NO: 27653 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggtaactatccaaactggttccagcagaaacctggacaaacacccagggcactgatttatagtacaagcaacaaacactcctggacccctgcccggttctcaggctccctccttgggggcaaaggtgccctgacactgtcaggtgtgcagcctgaggacgaggctgagtattactgcctgatctactatggtggtgctcagctgatgttcggcggagggaccaagctgaccgtccta

SEQ ID NO: 27654 - protein, 110 aa, Artificial Sequence
  Description of Artificial Sequence: Synthetic polypeptide
QTVVTQEPSLTVSPGGTVTLTCASSTGAVTSGNYPNWFQQKPGQTPRALIYSTSNKHSWTPARFSGSLLGGKGALTLSGVQPEDEAEYYCLIYYGGAQLMFGGGTKLTVL

SEQ ID NO: 27655 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggggttttcggcggagggaccaagctgaccgtccta

SEQ ID NO: 27656 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL

SEQ ID NO: 27657 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttcctttccaagctggttccagcagaaacctggacaagcacccagggcactgatttatagtacaagcaacagacactcctcgacccctgcccggttctcaggctccctccttgggggcaaagcagccctgacactgtcaggtgtgcagcctgaggacgaggctgactattactgcctgatctactatggtggtgctcagctggcattcggcggagggaccaagctgaccgtccta

SEQ ID NO: 27658 - protein, 110 aa, Artificial Sequence
  Description of Artificial Sequence: Synthetic polypeptide
QTVVTQEPSLTVSPGGTVTLTCASSTGAVTSGSFPSWFQQKPGQAPRALIYSTSNRHSSTPARFSGSLLGGKAALTLSGVQPEDEADYYCLIYYGGAQLAFGGGTKLTVL

SEQ ID NO: 27659 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcaaggattcctgaccgattctctggctccaagtctggcacgtcagccaccctgggcatcaccggactccagactggggaggaggccgattattactgcggaacatgggatagcagcctgagtgttggggtattcggcggagggaccaagctgaccgtctta

SEQ ID NO: 27660 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSRIPDRFSGSKSGTSATLGITGLQTGEEADYYCGTWDSSLSVGVFGGGTKLTVL

SEQ ID NO: 27661 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattggggtatagatctgtttgctggtatcagcagaagccaggccagtcccctgtgctggtcatctatgaagatagcaagcgaccctcagggatccctgagcgattctctggctccaactctgggaacacagccactctgaccatcagcgggacccaggctatggatgaggctgactattactgtcaggcgtgggacagtgtcactgtggtattcggcggagggaccaagctgatcgtccta

SEQ ID NO: 27662 - protein, 106 aa, Artificial Sequence
  Description of Artificial Sequence: Synthetic polypeptide
SYELTQPPSVSVSPGQTASITCSGDKLGYRSVCWYQQKPGQSPVLVIYEDSKRPSGIPERFSGSNSGNTATLTISGTQAMDEADYYCQAWDSVTVVFGGGTKLIVL

SEQ ID NO: 27663 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtcatactgtaaactggtaccagcaactcccaggaacggcccccaaactcctcatctataataattatcagcggccctcaggggtccctgaccgattctctggctccaagtctggcacctcagcctccctgaccatcagtgggctccagtctgaggatgaggctgattattactgtgcaacatgggatgacagcctgagtgtttgggtgttcggcggagggaccaaggtgaccgtccta

SEQ ID NO: 27664 - protein, 110 aa, Artificial Sequence
  Description of Artificial Sequence: Synthetic polypeptide
QSVLTQPPSASGTPGQRVTISCSGSSSNIGSHTVNWYQQLPGTAPKLLIYNNYQRPSGVPDRFSGSKSGTSASLTISGLQSEDEADYYCATWDDSLSVWVFGGGTKVTVL

SEQ ID NO: 27665 - DNA, 318 bp, Artificial Sequence
  Description of Artificial Sequence: Synthetic polynucleotide
tcctatgagctgactcagccaccctcagtgtccgtgtccccaggacagacagccagcatcacctgctcaggagataaattggggaataaatatgcttactggtatcagcagaagccaggccagtcccctgtgctggtcatctatcaagataggaagcggccctcagggatccctgagcgattctctggctccaattctgggaacacaggcactttgaccatcagcgggacccagggtatggatgaggctgactattactgtcaggcgtgggacagaggaattgtggtattcggcggagggaccaagctgaccgtccta

SEQ ID NO: 27666 - protein, 106 aa, Artificial Sequence
  Description of Artificial Sequence: Synthetic polypeptide
SYELTQPPSVSVSPGQTASITCSGDKLGNKYAYWYQQKPGQSPVLVIYQDRKRPSGIPERFSGSNSGNTGTLTISGTQGMDEADYYCQAWDRGIVVFGGGTKLTVL

SEQ ID NO: 27667 - DNA, 330 bp, Artificial Sequence
  Description of Artificial Sequence: Synthetic polynucleotide
cagtatgtgttgacgcagccgccctcagtgtctgcggccccaggacagaaggtcaccatctcctgttctggaggcagctccaacattgggaataattatgtatcctggttccagcagttcccaggaacagcccccaaattcctcatttatgacaataataagcgaccctcagggattcttgaccgattctctggctccaagtctggcacgtcagccaccctgggcatcaccggactccagactggggacgaggccgattattactgcggaacatgggatcgcaccatgagtgattgggtattcggcggagggaccaagttgaccgtccta

SEQ ID NO: 27668 - protein, 110 aa, Artificial Sequence
  Description of Artificial Sequence: Synthetic polypeptide
QYVLTQPPSVSAAPGQKVTISCSGGSSNIGNNYVSWFQQFPGTAPKFLIYDNNKRPSGILDRFSGSKSGTSATLGITGLQTGDEADYYCGTWDRTMSDWVFGGGTKLTVL

SEQ ID NO: 27669 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtgcttactatccaaactggttgcagcagaaacctggacaagcacccaggacactgatttatagtacaaacaacaaacactcctggacccctgcccggttctcaggctccctccttgggggcaaagctgccctgacactgtcagatgtgcagcctgaggacgaggctgagtattactgcctgattttctatggtggtgtacatgtgatatttggcggagggaccaagctgaccgtccta

SEQ ID NO: 27670 - protein, 110 aa, Artificial Sequence; identical to SEQ ID NO: 27636
  Description of Artificial Sequence: Synthetic polypeptide

SEQ ID NO: 27671 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataaatatgtatcctggtaccagcagttcccaggaacagcccccaaactcctcatttatgacaataataagcgaccctcaaagattcctgaccgattctctggctccaaatctggcacgtcagccaccctgggcatcaccggactcctgactggggacgaggccgattattactgcggaatatgggatcgcagtctgagtgttatggtgttcggcggagggaccaagctgaccgtccta

SEQ ID NO: 27672 - protein, 110 aa, Artificial Sequence
  Description of Artificial Sequence: Synthetic polypeptide
QSVLTQPPSVSAAPGQKVTISCSGSSSNIGNKYVSWYQQFPGTAPKLLIYDNNKRPSKIPDRFSGSKSGTSATLGITGLLTGDEADYYCGIWDRSLSVMVFGGGTKLTVL

SEQ ID NO: 27673 - DNA, 330 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagtaatactgtaaactggtaccagcaactcccaggaacggcccccaaactcctcatttatagtaataatcagcggccctcaggggtccctgaccgattctctggctccaagtctggcacctcagcctccctggccatcagtgggctccagtctgaggatgaggctgattattactgtgcagcatgggatgacagtatgaatggtccggtgttcggcggagggaccaagctgaccgtccta

SEQ ID NO: 27674 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSMNGPVFGGGTKLTVL

SEQ ID NO: 27675 - DNA, 330 bp, Artificial Sequence
  Description of Artificial Sequence: Synthetic polynucleotide
cagactgtggtgactcaggagccctcactgactgtgtccccaggagggacagtcactctcacctgtgctttcagcactggatcagtcaccagtggttcctatccaaactggttccagcagaaacctggacaagcacccagggcactgatttatagtacaaacaacaaacactcctggacccctgcccggttctcaggctccctccttgggggcaaagctgccctgacactgtcaggtgtgcagcctgaggacgaggctgagtattactgcctgctctactatggtggtgctcagctggtgttcggcggagggaccaagctgaccgtccta

SEQ ID NO: 27676 - protein, 110 aa, Artificial Sequence
  Description of Artificial Sequence: Synthetic polypeptide
QTVVTQEPSLTVSPGGTVTLTCAFSTGSVTSGSYPNWFQQKPGQAPRALIYSTNNKHSWTPARFSGSLLGGKAALTLSGVQPEDEAEYYCLLYYGGAQLVFGGGTKLTVL

SEQ ID NO: 27677 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtgcttactatccaaactggttgcagcagaaacctggacaagcacccaggacactgatttatagtacaagcaacaaacactcctggacccctgcccggttctcaggctccctccttgggggcaaagctgccctgacactgtcagatgtgcagcctgaggacgaggctgagtattactgcctgatcttctatggtggtgtacatgtgatatttggcggagggaccaagctgaccgtccta

SEQ ID NO: 27678 - protein, 110 aa, Artificial Sequence
  Description of Artificial Sequence: Synthetic polypeptide
QTVVTQEPSLTVSPGGTVTLTCASSTGAVTSAYYPNWLQQKPGQAPRTLIYSTSNKHSWTPARFSGSLLGGKAALTLSDVQPEDEAEYYCLIFYGGVHVIFGGGTKLTVL

SEQ ID NO: 27679 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacatcgggaataattatatatcctggtaccagcagctcccaggaacagcccccaaactcctcatttatgacaataaaaagcgaccctcagggattcctgaccgattctctggctccaagtctggcacgtcagccaccctgggcatcaccggactccagactggggacgaggccgattattactgcggaacatgggatagcagcctgagtgtttgtgtcttcggaactgggaccaaggtcaccgtccta

SEQ ID NO: 27680 - protein, 110 aa, Artificial Sequence
  Description of Artificial Sequence: Synthetic polypeptide
QSVLTQPPSVSAAPGQKVTISCSGSSSNIGNNYISWYQQLPGTAPKLLIYDNKKRPSGIPDRFSGSKSGTSATLGITGLQTGDEADYYCGTWDSSLSVCVFGTGTKVTVL

SEQ ID NO: 27681 - DNA, 330 bp, Artificial Sequence
  Description of Artificial Sequence: Synthetic polynucleotide
cagaccgtggtgactcaggagtcctcactgactgtgtccccaggagggacagtcactctcacttgtgttcttagcactggagcagtcaccagtggttcctttccaaactggttccagcagaaacctggacaagcacccagggctctgatttatagtacaagcaacaaacattcctggacccctgcccggttttcaggctccctccttgggggcaaagctgccctgacattgtcaggtgtgcagcctgaggacgaggctgattattacttcatgctttacagtggtggagctcagatggtgttcggcggagggaccaagctgaccgtccta

SEQ ID NO: 27682 - protein, 110 aa, Artificial Sequence
  Description of Artificial Sequence: Synthetic polypeptide
QTVVTQESSLTVSPGGTVTLTCVLSTGAVTSGSFPNWFQQKPGQAPRALIYSTSNKHSWTPARFSGSLLGGKAALTLSGVQPEDEADYYFMLYSGGAQMVFGGGTKLTVL

SEQ ID NO: 27683 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcaactcccaggaacagcccccaaactcctcatttatgacaataataagcgcccctcagggattcctgaccgattctctggctccaagtctggcacgtcagccaccctgggcatcaccggcctccagactggggacgaggccgattattactgcggaacatgggatagcagcctgagtgcttgtgtcttcggaactgggaccaaggtcaccgtccta

SEQ ID NO: 27684 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSACVFGTGTKVTVL

SEQ ID NO: 27685 - DNA, 330 bp, Artificial Sequence
  Description of Artificial Sequence: Synthetic polynucleotide
cagtctgtgttgactcagccaccctcagcgtctgggacccccgggcagagggtcaccatctcttgttctggaagcagctccaacatcggaagtaatactgtaaactggtaccagcagctcccaggaacggcccccaaactcctcatttatagtaataatcagcggccctcaggggtccctgaccgattctctggctccaagtctggcacctcagcctccctggccatcagtgggctccagtctgaggatgaggctgattattactgtgcagcatgggatgacagcctgaatggtccggtgttcggcggagggaccaagctgaccgtccta

SEQ ID NO: 27686 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 27687 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccaacactggagcagtcaccagtggttcctatccaaactggttccagcagaaacctggacaggcacccagggcactgatttatcatacaaacaacaaacactcctggacccctgcccggttctcaggctccctccttgggggcaaagctgccctgacactgtcaggtgtgcagcctgaggacgaggctgaatattactgtctgatctactatggtggtgctcagctggtgttcggcggagggaccaagctgaccgtccta

SEQ ID NO: 27688 - protein, 110 aa, Artificial Sequence
  Description of Artificial Sequence: Synthetic polypeptide
QTVVTQEPSLTVSPGGTVTLTCASNTGAVTSGSYPNWFQQKPGQAPRALIYHTNNKHSWTPARFSGSLLGGKAALTLSGVQPEDEAEYYCLIYYGGAQLVFGGGTKLTVL

SEQ ID NO: 27689 - DNA, 330 bp, Artificial Sequence
  Description of Artificial Sequence: Synthetic polynucleotide
cagtctgtgttgacgcagccgccctcagtgtctgcggccccaggacagagggtcaccatctcctgctctggaagcagctccaaccttggaaataattttgtatcctggtaccagcagttcccaggaacagcccccaaactcctcatttatgacaattataagcgaccctcagggattcctgaccgattctctgtctccaagtctggcacgtcagccaccctgggcatcaccggactccagactggggacgaggccgattattactgcggaacttgggatagcagcctgaatactggggtattcggcggagggaccaagctgaccgtccta

SEQ ID NO: 27690 - protein, 110 aa, Artificial Sequence; identical to SEQ ID NO: 27624
  Description of Artificial Sequence: Synthetic polypeptide

SEQ ID NO: 27691 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccaacactggagcagtcaccagtggttcctatccaaattggttacagcagaaacctggacaagcacccagggcactgatttatcatacagacaacaaacactcctggacccctgcccggttctcaggctccctccttgggggcaaagctgccctgacactgtcaggtgcgcagcctgaggacgaggctgaatattactgtctgatctactatggtggtgctcagctggtgttcggcggagggaccaagctgaccgtccta

SEQ ID NO: 27692 - protein, 110 aa, Artificial Sequence
  Description of Artificial Sequence: Synthetic polypeptide
QTVVTQEPSLTVSPGGTVTLTCASNTGAVTSGSYPNWLQQKPGQAPRALIYHTDNKHSWTPARFSGSLLGGKAALTLSGAQPEDEAEYYCLIYYGGAQLVFGGGTKLTVL

SEQ ID NO: 27693 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttactatccaaactggttccagcagaaacctggacaagtacccagggcactgatttatagtacaaacaacaaacactcctggacccctgcccggttctcaggctccctccttgggggcaaagctgccctgacactgtcaggtgtgcagcctgaggacgaggctgactattactgcctgctctattatggtggtgctcacctggcattcggcggagggaccaagctgaccgtcctg

SEQ ID NO: 27694 - protein, 110 aa, Artificial Sequence
  Description of Artificial Sequence: Synthetic polypeptide
QTVVTQEPSLTVSPGGTVTLTCASSTGAVTSGYYPNWFQQKPGQVPRALIYSTNNKHSWTPARFSGSLLGGKAALTLSGVQPEDEADYYCLLYYGGAHLAFGGGTKLTVL

SEQ ID NO: 27695 - DNA, 318 bp, Artificial Sequence
  Description of Artificial Sequence: Synthetic polynucleotide
tcctatgagctgactcagccaccctcagtgtccgtgtccccaggacagacagccagcatcacctgttctggagataaattgggggatagatttgcttgctggtatcaacagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 27696 - protein, 106 aa, Artificial Sequence
  Description of Artificial Sequence: Synthetic polypeptide
SYELTQPPSVSVSPGQTASITCSGDKLGDRFACWYQQKPGQSPVLVIYQDSKRPSGIPERFSGSNSGNTATLTISGTQAMDEADYYCQAWDSSTVVFGGGTKLTVL

SEQ ID NO: 27697 - DNA, 318 bp, Artificial Sequence
  Description of Artificial Sequence: Synthetic polynucleotide
tcctatgagctgactcagccactctcagtgtcagtggccctgggacagacggccaggattacctgtgggggaaacaacattggaagaaaaaatgtgcactggtaccagcagaagccaggccagtcccctgtgttgatcatccatagggatagcgaccggccctctgggatccctgagcgattctctggctccaactcggggaacacggccaccctgaccatcagcagagcccaagccggggatgaggctgactattactgtcaggtgtgggacagcggcactgcggtattcggcggagggaccaagctgcccgtccta

SEQ ID NO: 27698 - protein, 106 aa, Artificial Sequence
  Description of Artificial Sequence: Synthetic polypeptide
SYELTQPLSVSVALGQTARITCGGNNIGRKNVHWYQQKPGQSPVLIIHRDSDRPSGIPERFSGSNSGNTATLTISRAQAGDEADYYCQVWDSGTAVFGGGTKLPVL

SEQ ID NO: 27699 - DNA, 318 bp, Artificial Sequence
  Description of Artificial Sequence: Synthetic polynucleotide
tcctatgaactgactcagccaccctcagtgtccgtgtccccaggacagacagccagcatcacctgttctggagataaattgggggatagatttgcttgctggtatcaacagaagccaggccagtcccctgtactggtcatctatcaagataacaagcggccctcagggatccctgagcgattctctggctccaactctgggaacacagccactctgaccatcagcgggacccagtctatggatgaggctgactattactgtcaggcgtgggacagcagcactgtggtattcggcggagggaccaagctgaccgtcctg

SEQ ID NO: 27700 - protein, 106 aa, Artificial Sequence
  Description of Artificial Sequence: Synthetic polypeptide
SYELTQPPSVSVSPGQTASITCSGDKLGDRFACWYQQKPGQSPVLVIYQDNKRPSGIPERFSGSNSGNTATLTISGTQSMDEADYYCQAWDSSTVVFGGGTKLTVL

SEQ ID NO: 27701 - DNA, 318 bp, Artificial Sequence
  Description of Artificial Sequence: Synthetic polynucleotide
tcctatgagctgactcagccactctcagtgtcagcggccctgggacagacggccaggattacctgtgggggaaacaacattggaagaaaaaatgtgcactggtaccagcagaagccaggccagtcccctgtgttgatcatccatagggatagcgaccggccctctgggatccctgagcgattctctggctccaactcggggaacacggccaccctgaccatcagcagagcccaagccggggatgaggctgactattactgtcaggtgtgggacagcggcactgcggtattcggcggagggaccaagctgcccgtccta

SEQ ID NO: 27702 - protein, 106 aa, Artificial Sequence
  Description of Artificial Sequence: Synthetic polypeptide
SYELTQPLSVSAALGQTARITCGGNNIGRKNVHWYQQKPGQSPVLIIHRDSDRPSGIPERFSGSNSGNTATLTISRAQAGDEADYYCQVWDSGTAVFGGGTKLPVL

SEQ ID NO: 27703 - DNA, 318 bp, Artificial Sequence
  Description of Artificial Sequence: Synthetic polynucleotide
  modified_base (143)..(143): a, c, t, g, unknown or other
tcctatgaattgactcagccactctcagtgtcagtggccctgggacagacggccaggattgcctgtgggggaaacaacattggaagaaaaaatgtgcactggtaccagcagaagccaggcctggcccctgtgccggtcatccntagggatagctaccgatcttctgggatccctgacagattctctggctccaactgcgggaacacgaccaccgtgaccatcagcagagcccaagccggggaggaggcagagtattattgtcaggattgggacagcagcactgtggtgttcggcggagggaccaaactgaccgtccta

SEQ ID NO: 27704 - protein, 106 aa, Artificial Sequence
  Description of Artificial Sequence: Synthetic polypeptide
  MOD_RES (48)..(48): Any amino acid
SYELTQPLSVSVALGQTARIACGGNNIGRKNVHWYQQKPGLAPVPVIXRDSYRSSGIPDRFSGSNCGNTTTVTISRAQAGEEAEYYCQDWDSSTVVFGGGTKLTVL

SEQ ID NO: 27705 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggagtaattttttatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggggtattcggcggagggaccaagctgaccgtccta

SEQ ID NO: 27706 - protein, 110 aa, Artificial Sequence
  Description of Artificial Sequence: Synthetic polypeptide
QSVLTQPPSVSAAPGQKVTISCSGSSSNIGSNFLSWYQQLPGTAPKLLIYDNNKRPSGIPDRFSGSKSGTSATLGITGLQTGDEADYYCGTWDSSLSAGVFGGGTKLTVL

SEQ ID NO: 27707 - DNA, 318 bp, Artificial Sequence
  Description of Artificial Sequence: Synthetic polynucleotide
tcctatgaattgactcagccactctcagtgtcagtggccctgggacagacggccaggattgcctgtgggggaaacaacattggaagaaaaaatgtgcactggtaccagcagaagccaggcctggcccctgtgccggtcatccttagggatagctaccggtcttctgggatccctgacagattctctggctccaactgggggaacacggccaccgtgaccatcagcagagcccaagccggggaggaggcagagtattattgtcaggattgggacagcagcactgtggtgttcggcggagggaccaaactgaccgtccta

SEQ ID NO: 27708 - protein, 106 aa, Artificial Sequence
  Description of Artificial Sequence: Synthetic polypeptide
SYELTQPLSVSVALGQTARIACGGNNIGRKNVHWYQQKPGLAPVPVILRDSYRSSGIPDRFSGSNWGNTATVTISRAQAGEEAEYYCQDWDSSTVVFGGGTKLTVL

SEQ ID NO: 27709 - DNA, 330 bp, Artificial Sequence
  Description of Artificial Sequence: Synthetic polynucleotide
cagactgtggtgactcaggagccctcactgactgtgtccccaggagggacagtcactctcacctgtgctttcagcactggagcagtcaccagtggtaattatccaaactggttccagcagaaacctggacaagcacccagggcactgatttacagtacaagcaacaaacactcctggacccctgcccggttctcaggctccctccttgggggcaaagctgccctgacactgtcaggtgtgcagcctgaggacgaggctgaatattactgcctgctctactatggtggtgctcagctggtgttcggcggagggaccaagctgaccgtccta

SEQ ID NO: 27710 - protein, 110 aa, Artificial Sequence
  Description of Artificial Sequence: Synthetic polypeptide
QTVVTQEPSLTVSPGGTVTLTCAFSTGAVTSGNYPNWFQQKPGQAPRALIYSTSNKHSWTPARFSGSLLGGKAALTLSGVQPEDEAEYYCLLYYGGAQLVFGGGTKLTVL

SEQ ID NO: 27711 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaattcatgatttatgaggtcaggaatcggccctcaggggtttctaatcgcttctctggctccaagtctggcaacacggcctccctgaccatctctgggctccaggctgaggacgaggctgattattactgcagctcatataccagcagccgcactctggtattcggcggagggaccaagttgaccgtccta

SEQ ID NO: 27712 - protein, 110 aa, Artificial Sequence
  Description of Artificial Sequence: Synthetic polypeptide
QSALTQPASVSGSPGQSITISCTGTSSDVGGYNYVSWYQQHPGKAPKFMIYEVRNRPSGVSNRFSGSKSGNTASLTISGLQAEDEADYYCSSYTSSRTLVFGGGTKLTVL

SEQ ID NO: 27713 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataattatgtctcctggtaccaacaacacccagtcaaagcccccaaactcttgatttatgaggtcagtaatcggccctcaggggtttctaatcgcttctctggctccaagtctggcaacacggcctccctgaccatctctgggctccaggctgaggacgaggctgattattactgcaactcatatacaagcagcatcacttgggtgttcggcggagggaccaagctgaccgtccta

SEQ ID NO: 27714 - protein, 110 aa, Artificial Sequence
  Description of Artificial Sequence: Synthetic polypeptide
QSALTQPASVSGSPGQSITISCTGTSSDVGGYNYVSWYQQHPVKAPKLLIYEVSNRPSGVSNRFSGSKSGNTASLTISGLQAEDEADYYCNSYTSSITWVFGGGTKLTVL

SEQ ID NO: 27715 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcggctcatatgtaaaaggcatcacttgggtgttcggcggagggaccagtctaaccgtcctc

SEQ ID NO: 27716 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCGSYVKGITWVFGGGTSLTVL

SEQ ID NO: 27717 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagtagtgacgttggtagttataactatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcaactcatatacaagcagcatcacttgggtgttcggcggagggaccaagctgaccgtccta

SEQ ID NO: 27718 - protein, 110 aa, Artificial Sequence
  Description of Artificial Sequence: Synthetic polypeptide
QSALTQPASVSGSPGQSITISCTGTSSDVGSYNYVSWYQQYPGKAPKLMIYEVSNRPSGVSNRFSGSKSGNTASLTISGLQAEDEADYYCNSYTSSITWVFGGGTKLTVL

SEQ ID NO: 27719 - DNA, 318 bp, Artificial Sequence
  Description of Artificial Sequence: Synthetic polynucleotide
tcctatgaactgactcagccactctcagtgtcagtggccctgggacagacggccaggattacctgtgggggaaacaacattggacgtagaaatgtgcactggtaccaacagaagccaggccaggcccctatactggtcatctatagagatcgcgaccggccctctgggatccctgagcgattctctggctccaactcggggaacacggccaccctgaccatcagcagagcccaagccggggatgaggctgactatttctgtcaggtgtgggacagcagtactgcggtgttcggcggagggaccaaactgaccgtccta

SEQ ID NO: 27720 - protein, 106 aa, Artificial Sequence
  Description of Artificial Sequence: Synthetic polypeptide
SYELTQPLSVSVALGQTARITCGGNNIGRRNVHWYQQKPGQAPILVIYRDRDRPSGIPERFSGSNSGNTATLTISRAQAGDEADYFCQVWDSSTAVFGGGTKLTVL

SEQ ID NO: 27721 - DNA, 321 bp, Artificial Sequence
  Description of Artificial Sequence: Synthetic polynucleotide
tcctatgagctgacacagccaccctcggtgtcagtgtccccaggacagacggccaggatcacctgttctggagatgcattgccaaagcaatatgcttattggtaccagcagaagccaggccaggccccagtgctggtgatatataaagacagtgcgaggccctcagggatccctgagcgattctctggctcccgctcagggacaacagtcacgttgaccgtcagtggagtccaggcagaagacgaggctgactattactgtcaattagtgtacagcagtgatacttatgtcttcggaactgggaccatgctcaccgtccta

SEQ ID NO: 27722 - protein, 107 aa, Artificial Sequence
  Description of Artificial Sequence: Synthetic polypeptide
SYELTQPPSVSVSPGQTARITCSGDALPKQYAYWYQQKPGQAPVLVIYKDSARPSGIPERFSGSRSGTTVTLTVSGVQAEDEADYYCQLVYSSDTYVFGTGTMLTVL

SEQ ID NO: 27723 - DNA, 330 bp, Artificial Sequence
  Description of Artificial Sequence: Synthetic polynucleotide
cagtctgccctgactcagcctgcctccgtgtctgggtctcctggacagtcgataaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcaactcatatacaagaagcatcacttgggtgttcggcggagggaccaagctgaccgtccta

SEQ ID NO: 27724 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCNSYTRSITWVFGGGTKLTVL

SEQ ID NO: 27725 - DNA, 330 bp, Artificial Sequence
  Description of Artificial Sequence: Synthetic polynucleotide
cagactgtggtgactcaggagccctcactgactgtgtccccaggagggacagtcactctcacctgtgctttcagcactggagcagtcaccagtggtaactatccaagttggttccagcagaaacctggacaagttcccagggcactgatttatagtacaagcaacagacactcctggacccctgcccggttttctggctccctccttgggggcaaagctgccctgacactgtcaggtgtgcagcctgaggacgaggctgaatattactgcctgctctactatggtggtgctcagctggtgttcggcggagggaccaagctgaccgtccta

SEQ ID NO: 27726 - protein, 110 aa, Artificial Sequence
  Description of Artificial Sequence: Synthetic polypeptide
QTVVTQEPSLTVSPGGTVTLTCAFSTGAVTSGNYPSWFQQKPGQVPRALIYSTSNRHSWTPARFSGSLLGGKAALTLSGVQPEDEAEYYCLLYYGGAQLVFGGGTKLTVL

SEQ ID NO: 27727 - DNA, 330 bp, Artificial Sequence
  Description of Artificial Sequence: Synthetic polynucleotide
cagactgtggtgactcaggagccctcactgactgtgtccccaggagggacagtcactctcacctgtggttccagcactggatcagtcaccagtggttactttccaaactggttccagcagaaacctggacaagcacccaggccactgatttatagtacaaacaacaagcactcctggacccctgcccggttctcaggctccctccttgggggcaaagctgccctgacactgtcagatgtgcagcctgaggacgaggctgactattactgcctgctctactatggtggtgctcagctggcattcggcggagggaccaaactgaccgtccta

SEQ ID NO: 27728 - protein, 110 aa, Artificial Sequence
  Description of Artificial Sequence: Synthetic polypeptide
QTVVTQEPSLTVSPGGTVTLTCGSSTGSVTSGYFPNWFQQKPGQAPRPLIYSTNNKHSWTPARFSGSLLGGKAALTLSDVQPEDEADYYCLLYYGGAQLAFGGGTKLTVL

SEQ ID NO: 27729 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggtaactatccaaactggttccagcagaaacctggacaagcacccagggcactgatttatagtacaatcaacaaacactccgggacccctgcccggtttacaggcttcctccttgggggcaaagctgccctgacactgtcaggtgtacagcctgaggacgaggctgagtattactgcctgctctactatggtggtgctcagctggcattcggcggagggaccaagctgaccgtccta

SEQ ID NO: 27730 - protein, 110 aa, Artificial Sequence
  Description of Artificial Sequence: Synthetic polypeptide
QTVVTQEPSLTVSPGGTVTLTCASSTGAVTSGNYPNWFQQKPGQAPRALIYSTINKHSGTPARFTGFLLGGKAALTLSGVQPEDEAEYYCLLYYGGAQLAFGGGTKLTVL

SEQ ID NO: 27731 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgaggtcagaaatcggccctcaggagtttctaatcgcttctctggctccaagtctggcaacacggcctccctgaccatctctgggctccaggctgaggacgaggctgattattactgcagctcatatacacgcagcatcacttgggtgttcggcggagggaccaagctgaccgtccta

SEQ ID NO: 27732 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVRNRPSGVSNRFSGSKSGNTASLTISGLQAEDEADYYCSSYTRSITWVFGGGTKLTVL

SEQ ID NO: 27733 - DNA, 330 bp, Artificial Sequence; identical to SEQ ID NO: 27715
  Description of Artificial Sequence: Synthetic polynucleotide

SEQ ID NO: 27734 - protein, 110 aa, Artificial Sequence; identical to SEQ ID NO: 27716
  Description of Artificial Sequence: Synthetic polypeptide

SEQ ID NO: 27735 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagtagtgacgttggtggttataactatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcaactcatatacaagcagcatcacttgggtgttcggcggagggaccaagctgaccgtccta

SEQ ID NO: 27736 - protein, 110 aa, Artificial Sequence
  Description of Artificial Sequence: Synthetic polypeptide
QSALTQPASVSGSPGQSITISCTGTSSDVGGYNYVSWYQQYPGKAPKLMIYEVSNRPSGVSNRFSGSKSGNTASLTISGLQAEDEADYYCNSYTSSITWVFGGGTKLTVL

SEQ ID NO: 27737 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataattatgtctcctggtaccaacagcacccaggcaaaacccccaaactcatgatttatgaggtcagtaatcggccctcaggggtttctaatcgcttctctggctccaagtctggcaacacggcctccctgaccatctctgggctccaggctgaggacgaggctgattattactgcaactcatatacaagcagcatcacttgggtgttcggcggagggaccaagctgaccgtccta

SEQ ID NO: 27738 - protein, 110 aa, Artificial Sequence
  Description of Artificial Sequence: Synthetic polypeptide
QSALTQPASVSGSPGQSITISCTGTSSDVGGYNYVSWYQQHPGKTPKLMIYEVSNRPSGVSNRFSGSKSGNTASLTISGLQAEDEADYYCNSYTSSITWVFGGGTKLTVL

SEQ ID NO: 27739 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaaacaacaaacactcctggacccctgcccggttctcaggctccctccttgggggcaaagctgccctgacactgtcaggtgtacagcctgacgacgaggctgactattactgcctgctctactatggtggtgctcaggtgggattcggcggagggaccaagctgaccgtccta

SEQ ID NO: 27740 - protein, 110 aa, Artificial Sequence
  Description of Artificial Sequence: Synthetic polypeptide
QTVVTQEPSLTVSPGGTVTLTCASSTGAVTSGYYPNWFQQKPGQAPRALIYSTNNKHSWTPARFSGSLLGGKAALTLSGVQPDDEADYYCLLYYGGAQVGFGGGTKLTVL

SEQ ID NO: 27741 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcatgtggtattcggcggagggaccaagctgaccgtccta

SEQ ID NO: 27742 - protein, 110 aa, Artificial Sequence
  Description of Artificial Sequence: Synthetic polypeptide
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAHVVFGGGTKLTVL

SEQ ID NO: 27743 - DNA, 330 bp, Artificial Sequence
  Description of Artificial Sequence: Synthetic polynucleotide
ctgtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttctgaggtcaggaatcggccctcaggggtttctaatcgcttctctggctccaagtctggcaacacggcctccctgaccatctctgggctccaggctgaggacgaggctgattattactgcaactcatatacacgcagcatcacttgggtgttcggcggagggaccaagctgaccgtccta

SEQ ID NO: 27744 - protein, 110 aa, Artificial Sequence
  Description of Artificial Sequence: Synthetic polypeptide
LSALTQPASVSGSPGQSITISCTGTSSDVGGYNYVSWYQQHPGKAPKLMISEVRNRPSGVSNRFSGSKSGNTASLTISGLQAEDEADYYCNSYTRSITWVFGGGTKLTVL

SEQ ID NO: 27745 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcgtgatttatgaggtccgtaatcggccctcaggggtttctactcgcttctctggctccaagtctggcaacaaggcctccctgaccatctctgggctccaggctgaggacgaggctgattattactgctgctcatatacaagaagaatcacttgggtgttcggcggagggaccaagctgaccgtcctg

SEQ ID NO: 27746 - protein, 110 aa, Artificial Sequence
  Description of Artificial Sequence: Synthetic polypeptide
QSALTQPASVSGSPGQSITISCTGTSSDVGGYNYVSWYQQHPGKAPKLVIYEVRNRPSGVSTRFSGSKSGNKASLTISGLQAEDEADYYCCSYTRRITWVFGGGTKLTVL

SEQ ID NO: 27747 - DNA, 330 bp, Artificial Sequence
  Description of Artificial Sequence: Synthetic polynucleotide
cagactgtggtgactcaggagccctcactgactgtgtccccaggagggacagtcactctcacctgtggttccagcactggatcagtcaccagtggttactttccaaactggttccagcagaaacctggacaaacacccaggccactgatttatagtacaaacaacaagcactcctggacccctgcccggttctcaggctccctccttgggggcaaaactgccctgacactgtcagatgtgcagcctgaggacgaggctgactattactgcctgctctactttggtggtgctcagctggcattcggcggagggaccaaactgaccgtccta

SEQ ID NO: 27748 - protein, 110 aa, Artificial Sequence
  Description of Artificial Sequence: Synthetic polypeptide
QTVVTQEPSLTVSPGGTVTLTCGSSTGSVTSGYFPNWFQQKPGQTPRPLIYSTNNKHSWTPARFSGSLLGGKTALTLSDVQPEDEADYYCLLYFGGAQLAFGGGTKLTVL

SEQ ID NO: 27749 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaattcatgatttatgaggtcaggaatcggccctcaggggtttctaatcgcttctctggctccaagtctggcaacacggcctccctgaccatctctgggctccaggctgaggacgaggctgattattactgcagctcatataccagcagccgcactctggtattcggcggagggaccaagttgaccgtccta

SEQ ID NO: 27750 - protein, 110 aa, Artificial Sequence; identical to SEQ ID NO: 27712
  Description of Artificial Sequence: Synthetic polypeptide

SEQ ID NO: 27751 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctgtacccctgcccggttctcaggctccctccttgggggcaaagctgccctgacactgtcaggtgtgcagcctgaggacgaggctgagtattactgcctgctctactatggtggtgctcatgtggtattcggcggagggaccaagctgaccgtccta

SEQ ID NO: 27752 - protein, 110 aa, Artificial Sequence
  Description of Artificial Sequence: Synthetic polypeptide
QTVVTQEPSLTVSPGGTVTLTCASSTGAVTSGYYPNWFQQKPGQAPRALIYSTSNKHSCTPARFSGSLLGGKAALTLSGVQPEDEAEYYCLLYYGGAHVVFGGGTKLTVL

SEQ ID NO: 27753 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcagttcccaggaacagcccccaaactcctcattcatgacaataataagcgaccctcagggattcctgaccgattctctggctccaagtctggcacgtcagccaccctgggcatcaccggactccagactggggacgaggccgattattactgcggagcatgggatagcagcctgagtgctgtggtaatcggcggagggagcaagctgaccgtccta

SEQ ID NO: 27754 - protein, 110 aa, Artificial Sequence
  Description of Artificial Sequence: Synthetic polypeptide
QSVLTQPPSVSAAPGQKVTISCSGSSSNIGNNYVSWYQQFPGTAPKLLIHDNNKRPSGIPDRFSGSKSGTSATLGITGLQTGDEADYYCGAWDSSLSAVVIGGGSKLTVL

SEQ ID NO: 27755 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggctactatccaaactggttccaacagaaacctggacaagcacccagggcactgatttatagtacaagcaataaacactcctggacccctgcccggttctcaggctccctccttgggggcaaagctgccctgacactgtcagatgtgcagcctgaggacgaggctgagtattactgcctgctctactgtgatggtgcccagctggtgttcggcggagggaccaaactgaccgtccta

SEQ ID NO: 27756 - protein, 110 aa, Artificial Sequence
  Description of Artificial Sequence: Synthetic polypeptide
QTVVTQEPSLTVSPGGTVTLTCASSTGAVTSGYYPNWFQQKPGQAPRALIYSTSNKHSWTPARFSGSLLGGKAALTLSDVQPEDEAEYYCLLYCDGAQLVFGGGTKLTVL

SEQ ID NO: 27757 - DNA, 330 bp, Artificial Sequence
  Description of Artificial Sequence: Synthetic polynucleotide
cagactgtggtgactcaggagccctcactgacggtgtccccaggagggacagtcactctcacctgtgcttccagcactgaagccgtcaccagtggtaactatccaagctggttccagcagaaacctggacaagcacccagggcactgatttatagtacaagcaacaaacactccggtacccctgcccggtttacaggctccctccttgggggcaaagctgccctgacactgtcaggtgtacagcctgaggacgaggctgagtattactgcctgctctactatggtggcgctcagctggcattcggcggagggaccaagctggccgtccta

SEQ ID NO: 27758 - protein, 110 aa, Artificial Sequence
  Description of Artificial Sequence: Synthetic polypeptide
QTVVTQEPSLTVSPGGTVTLTCASSTEAVTSGNYPSWFQQKPGQAPRALIYSTSNKHSGTPARFTGSLLGGKAALTLSGVQPEDEAEYYCLLYYGGAQLAFGGGTKLAVL

SEQ ID NO: 27759 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatttgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 27760 - protein, 106 aa, Artificial Sequence
  Description of Artificial Sequence: Synthetic polypeptide
SYELTQPPSVSVSPGQTASITCSGDKLGDKFACWYQQKPGQSPVLVIYQDSKRPSGIPERFSGSNSGNTATLTISGTQAMDEADYYCQAWDSSTVVFGGGTKLTVL

SEQ ID NO: 27761 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacattggtggttataactatgtctcctggtaccaacaacacccaggcaaagcccccacactcatgatttatgaggtcagtaatcggccctcaggggtttctaatcgcttctctggctccaagtctggcaacacggcctccctgaccatctctgggctccaggctgaggacgaggctgattattactgcaactcatataaaaggggcagcacttgggtgttcggcggagggaccaaggtgaccgtccta

SEQ ID NO: 27762 - protein, 110 aa, Artificial Sequence
  Description of Artificial Sequence: Synthetic polypeptide
QSALTQPASVSGSPGQSITISCTGTSSDIGGYNYVSWYQQHPGKAPTLMIYEVSNRPSGVSNRFSGSKSGNTASLTISGLQAEDEADYYCNSYKRGSTWVFGGGTKVTVL

SEQ ID NO: 27763 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaaacaacaaacactcctgtggacctgcccggttttcaggctccctccttgggggcaaagctgccctgacactgtcaggtgtacagcctgacgacgaggctgactattactgcctgctctactatggtggtgctcaggtgggattcggcggagggaccaagctgaccgtccta

SEQ ID NO: 27764 - protein, 110 aa, Artificial Sequence
  Description of Artificial Sequence: Synthetic polypeptide
QTVVTQEPSLTVSPGGTVTLTCASSTGAVTSGYYPNWFQQKPGQAPRALIYSTNNKHSCGPARFSGSLLGGKAALTLSGVQPDDEADYYCLLYYGGAQVGFGGGTKLTVL

SEQ ID NO: 27765 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataattatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcaactcatatacaagcagcatcacttgggtgttcggcggagggaccaagctgaccgtccta

SEQ ID NO: 27766 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCNSYTSSITWVFGGGTKLTVL

SEQ ID NO: 27767 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaaacaacaaacactcctgtacccctgcccggttctcaggctccctccttgggggcaaagctgccctgacactgtcaggtgtacagcctgacgacgaggctgactattactgcctgctctactatggtggtgctcaggtgggattcggcggagggaccaagctgaccgtccta

SEQ ID NO: 27768 - protein, 110 aa, Artificial Sequence
  Description of Artificial Sequence: Synthetic polypeptide
QTVVTQEPSLTVSPGGTVTLTCASSTGAVTSGYYPNWFQQKPGQAPRALIYSTNNKHSCTPARFSGSLLGGKAALTLSGVQPDDEADYYCLLYYGGAQVGFGGGTKLTVL

SEQ ID NO: 27769 - DNA, 330 bp, Artificial Sequence
  Description of Artificial Sequence: Synthetic polynucleotide
cagactgtggtgactcaggagccctcactgactgtgtccccaggagggacagtcactctcacctgtgcttccagcactggagcagtcaccagtggctactatccaaactggttccaacagaaacctggacaagcacccagggcactgatttatagtacaagcaataaacactcctggacccctgcccggttctcaggctccctccttgggggcaaagctgccctgacactgtcagatgtgcagcctgaggacgaggctgagtattactgcctgctctactgtgatggtgctcagctggtgttcggcggagggaccaaactgaccgtccta

SEQ ID NO: 27770 - protein, 110 aa, Artificial Sequence; identical to SEQ ID NO: 27756
  Description of Artificial Sequence: Synthetic polypeptide

SEQ ID NO: 27771 - DNA, 318 bp, Artificial Sequence
  Description of Artificial Sequence: Synthetic polynucleotide
tcctatgagctgactcagccactctcagtgtcagtggccctgggacagacggccaggattacctgtgggggagacaacattagaagaagaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactggggtgttcggcggagggaccaagctgaccgtccta

SEQ ID NO: 27772 - protein, 106 aa, Artificial Sequence
  Description of Artificial Sequence: Synthetic polypeptide
SYELTQPLSVSVALGQTARITCGGDNIRRRNVHWYQQKPGQAPVLVIYRDSNRPSGIPERFSGSNSGNTATLTISRAQAGDEADYYCQVWDSSTGVFGGGTKLTVL

SEQ ID NO: 27773 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcttgatttatgaggtcagtaatcggccctcaggggtttataatcgcttctctggctccaagtctggcaacacggcctccctgaccatctctgggctccaggctgaggacgaggctgattattactgcggctcatatgtaaaaggcatcacttgggtgttcggcggagggaccagtctgaccgtcctc

SEQ ID NO: 27774 - protein, 110 aa, Artificial Sequence
  Description of Artificial Sequence: Synthetic polypeptide
QSALTQPASVSGSPGQSITISCTGTSSDVGGYNYVSWYQQHPGKAPKLLIYEVSNRPSGVYNRFSGSKSGNTASLTISGLQAEDEADYYCGSYVKGITWVFGGGTSLTVL

SEQ ID NO: 27775 - DNA, 321 bp, Artificial Sequence
  Description of Artificial Sequence: Synthetic polynucleotide
tcctatgagctgacacagccaccctcggtgtcagtgtccccaggacagacggccaggatcacctgctctggagatgcattgccaaagcaatatgcttattggtaccagcagaagccaggccaggccccagtgctggtgatatataaagacagtgagaggccctcagggattcctgagcgattctctggctcccgctcagggacaacagtcacgttgaccatcagaggagtccaggcagaagacgaggctgactattactgtcaattaatagtcagcagtgatacttatgtcttcggaactgggaccaaggtcaccgtccta

SEQ ID NO: 27776 - protein, 107 aa, Artificial Sequence
  Description of Artificial Sequence: Synthetic polypeptide
SYELTQPPSVSVSPGQTARITCSGDALPKQYAYWYQQKPGQAPVLVIYKDSERPSGIPERFSGSRSGTTVTLTIRGVQAEDEADYYCQLIVSSDTYVFGTGTKVTVL

SEQ ID NO: 27777 - DNA, 321 bp, Artificial Sequence
  Description of Artificial Sequence: Synthetic polynucleotide
tcctatgagctgacacagccaccctcggtgtcagtgtccccaggacagacggccaggatcacctgctctggagatgcattgccaaaacaatatgcttattggtaccagcagaagccaggccaggccccagtactggtgatatataaagacagtgagaggccctcagggatccctgagcgattctctggctcccgctcagggacaacagtcacgttgaccgtcagtggagtccaggcagaagacgaggctgactattactgtcaattagtgtacagcagtgatacttatgtcttcggaactgggaccaaggtcaccgtccta

SEQ ID NO: 27778 - protein, 107 aa, Artificial Sequence
  Description of Artificial Sequence: Synthetic polypeptide
SYELTQPPSVSVSPGQTARITCSGDALPKQYAYWYQQKPGQAPVLVIYKDSERPSGIPERFSGSRSGTTVTLTVSGVQAEDEADYYCQLVYSSDTYVFGTGTKVTVL

SEQ ID NO: 27779 - DNA, 330 bp, Artificial Sequence
  Description of Artificial Sequence: Synthetic polynucleotide
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcctttatgacagtaataagcgaccctcagggattcctgcccgattctctggctccaagtctggcacgtcagccaccctgggcatcaccggactccagactggggacgaggccgattattactgcggaacatgggatagcagcctgaatactgtggtattcggcggagggaccaagctgaccgtccta

SEQ ID NO: 27780 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLLYDSNKRPSGIPARFSGSKSGTSATLGITGLQTGDEADYYCGTWDSSLNTVVFGGGTKLTVL

SEQ ID NO: 27781 - DNA, 321 bp, Artificial Sequence
  Description of Artificial Sequence: Synthetic polynucleotide
tcctatgagctgacacagccaccctcggtgtcagtgtccccaggacagacggccaggatcacctgctctagagatgtattgccgaagcaatatgcttattggtaccagcagaagccaggccaggccccagtactggtgatatataaagacagtgagaggccctcagggatccctgagcgattctctggctcccgctcagggacaacagtcacgttgaccatcagaggagtccaggcagaagacgaggctgactattactgtcaattagttgtcagcagtgatacttatgtcttcggaactgggaccaaggtcaccgtccta

SEQ ID NO: 27782 - protein, 107 aa, Artificial Sequence
  Description of Artificial Sequence: Synthetic polypeptide
SYELTQPPSVSVSPGQTARITCSRDVLPKQYAYWYQQKPGQAPVLVIYKDSERPSGIPERFSGSRSGTTVTLTIRGVQAEDEADYYCQLVVSSDTYVFGTGTKVTVL

SEQ ID NO: 27783 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataattatgtctcctggtaccaacagcacccaggcaaagcccccaaactcatgatttatgaggtcagaaatcggccctcaggggtttctaaccgcttctctggctccaagtctggcaacacggcctccctgaccatctctgggctccaggctgaggacgaggctgattattactgctgctcatatacaaggagcatcacttgggtgttcggcggagggaccaagttgaccgtccta

SEQ ID NO: 27784 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVRNRPSGVSNRFSGSKSGNTASLTISGLQAEDEADYYCCSYTRSITWVFGGGTKLTVL

SEQ ID NO: 27785 - DNA, 330 bp, Artificial Sequence; identical to SEQ ID NO: 27743
  Description of Artificial Sequence: Synthetic polynucleotide

SEQ ID NO: 27786 - protein, 110 aa, Artificial Sequence; identical to SEQ ID NO: 27744
  Description of Artificial Sequence: Synthetic polypeptide

SEQ ID NO: 27787 - DNA, 330 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgaggtcaggaatcggccctcaggggtttctaatcgcttctctggctccaagtctggcaacacggcctccctgaccatctctgggctccaggctgaggacgaggctgattattactgcaactcatatacacgcagcatcacttgggtgttcggcggagggaccaagctgaccgtccta

SEQ ID NO: 27788 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYEVRNRPSGVSNRFSGSKSGNTASLTISGLQAEDEADYYCNSYTRSITWVFGGGTKLTVL

SEQ ID NO: 27789 - DNA, 318 bp, Artificial Sequence
  Description of Artificial Sequence: Synthetic polynucleotide
tcctatgagctgactcagccatcctcagtgtccgtgtccccaggacagacagccagcatcacctgctctggagataatttgggggttaaatatacttactggtatcagcagaagccaggccagtcccctgtgctagtcgtctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 27790 - protein, 106 aa, Artificial Sequence
  Description of Artificial Sequence: Synthetic polypeptide
SYELTQPSSVSVSPGQTASITCSGDNLGVKYTYWYQQKPGQSPVLVVYQDSKRPSGIPERFSGSNSGNTATLTISGTQAMDEADYYCQAWDSSTVVFGGGTKLTVL

SEQ ID NO: 27791 - DNA, 330 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctttggtaacagcaatcggccctcaggggtccctgaccgattctctggctccaagtctggcacctcagcctccctggccatcactgggctccaggctgaggatgaggctgattatcactgccagtcctatgacaacagcctgagtggtgtgttcggcggagggaccaagctgaccgtccta

SEQ ID NO: 27792 - protein, 110 aa, Artificial Sequence
  Description of Artificial Sequence: Synthetic polypeptide
QSVLTQPPSVSGAPGQRVTISCTGSSSNIGAGYDVHWYQQLPGTAPKLLIFGNSNRPSGVPDRFSGSKSGTSASLAITGLQAEDEADYHCQSYDNSLSGVFGGGTKLTVL

SEQ ID NO: 27793 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagataaattggggaataaatatgcttgctggtatcagcagaagccaggccagtcccctgtgttggtcatctatcaagatagcaagcggccctcagggatccctgagcgattctctggctccaactctgggaacacagccactctgaccatcagcgggacccaggctatggatgaggctgactattactgtcaggcgtgggacagcaacactgcatgtgtcttcggaactgggaccaaggtcaccgtccta

SEQ ID NO: 27794 - protein, 107 aa, Artificial Sequence
  Description of Artificial Sequence: Synthetic polypeptide
SYELTQPPSVSVSPGQTASITCSGDKLGNKYACWYQQKPGQSPVLVIYQDSKRPSGIPERFSGSNSGNTATLTISGTQAMDEADYYCQAWDSNTACVFGTGTKVTVL

SEQ ID NO: 27795 - DNA, 321 bp, Artificial Sequence
  Description of Artificial Sequence: Synthetic polynucleotide
tcctatgacctgactcagccaccctcagtgtccgtgtccccaggacagacagccagcatcacctgctctggagataatttggggaatagatatgcttgctggtatcagcagaagccaggccagtcccctgtactggtcatgtatcaagatcgcaagcggccctcagggatccctgagcgattctctggctccaactctgggaacacagccactctgaccatcagcgggacccaggctatggatgaggctgactattactgtcaggcgtgggacagcagaactgctgtggtattcggcggagggaccaagctgaccgtccta

SEQ ID NO: 27796 - protein, 107 aa, Artificial Sequence
  Description of Artificial Sequence: Synthetic polypeptide
SYDLTQPPSVSVSPGQTASITCSGDNLGNRYACWYQQKPGQSPVLVMYQDRKRPSGIPERFSGSNSGNTATLTISGTQAMDEADYYCQAWDSRTAVVFGGGTKLTVL

SEQ ID NO: 27797 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagatacattggggggtaaatatgcttggtggtatcagcagaggccaggccagtcccctgtgctggtcatctatcaagatcgcaagcggccctcagggatccctgagcgattctctggctccagctctgggaacacagccactctgaccatcagcgggacccaggctatggatgaggctgactattactgtcaggcgtgggacaacggcgctgcggttttcggcggagggaccaagctgaccgtccta

SEQ ID NO: 27798 - protein, 106 aa, Artificial Sequence
  Description of Artificial Sequence: Synthetic polypeptide
SYELTQPPSVSVSPGQTASITCSGDTLGGKYAWWYQQRPGQSPVLVIYQDRKRPSGIPERFSGSSSGNTATLTISGTQAMDEADYYCQAWDNGAAVFGGGTKLTVL

SEQ ID NO: 27799 - DNA, 321 bp, Artificial Sequence
  Description of Artificial Sequence: Synthetic polynucleotide
tcctttgagctgacacagccaccctcggtgtcagtgtccccaggacagacggccaggatcacctgctctggagatgcattgccaaggcattatgtttattggtaccagcagaacccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtcttcggaactgggaccaaggtcaccgtccta

SEQ ID NO: 27800 - protein, 107 aa, Artificial Sequence
  Description of Artificial Sequence: Synthetic polypeptide
SFELTQPPSVSVSPGQTARITCSGDALPRHYVYWYQQNPGQAPVLVIYKDSERPSGIPERFSGSSSGTTVTLTISGVQAEDEADYYCQSADSSGTYVFGTGTKVTVL

SEQ ID NO: 27801 - DNA, 330 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctgacacctcagcctccctggccatcactgggctccaggctgaggatgaggctgattattactgccagtcctatgacaacagcctgagtggtgtgttcggcggagggaccaagctgaccgtccta

SEQ ID NO: 27802 - protein, 110 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSDTSASLAITGLQAEDEADYYCQSYDNSLSGVFGGGTKLTVL

SEQ ID NO: 27803 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagatacattggggggtaaatatgcttggtggtatcagcagaagccaggccagtcccctgtgctggtcatctatcaagatcgcaagcggccctcagggatccctgagcgattctctggctccagctctgggaacacagccactctgaccatcagcgggacccaggctatggatgaggctgactattactgtcaggcgtgggacaacggcgctgcggttttcggcggagggaccaagctgaccgtccta

SEQ ID NO: 27804 - protein, 106 aa, Artificial Sequence
  Description of Artificial Sequence: Synthetic polypeptide
SYELTQPPSVSVSPGQTASITCSGDTLGGKYAWWYQQKPGQSPVLVIYQDRKRPSGIPERFSGSSSGNTATLTISGTQAMDEADYYCQAWDNGAAVFGGGTKLTVL

SEQ ID NO: 27805 - DNA, 330 bp, Artificial Sequence; identical to SEQ ID NO: 27801
  Description of Artificial Sequence: Synthetic polynucleotide

SEQ ID NO: 27806 - protein, 110 aa, Artificial Sequence; identical to SEQ ID NO: 27802
  Description of Artificial Sequence: Synthetic polypeptide

SEQ ID NO: 27807 - DNA, 318 bp, Artificial Sequence; identical to SEQ ID NO: 24733
  Description of Artificial Sequence: Synthetic polynucleotide

SEQ ID NO: 27808 - protein, 106 aa, Artificial Sequence; identical to SEQ ID NO: 24734
  Description of Artificial Sequence: Synthetic polypeptide

SEQ ID NO: 27809 - DNA, 330 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctgacacctcagcctccctggccatcactgggctccaggctgaggatgaggctgattattactgccagtcctatgacaacaacctgagtggtgtgttcggcggagggaccaagctgaccgtccta

SEQ ID NO: 27810 - protein, 110 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSDTSASLAITGLQAEDEADYYCQSYDNNLSGVFGGGTKLTVL

SEQ ID NO: 27811 - DNA, 318 bp, Artificial Sequence
  Description of Artificial Sequence: Synthetic polynucleotide
tcctatgaactgactcagccaccctcagtgtccgtgtccccaggacagacagccagcatcacctgctctggagataaattgggggataaatatgtttgttggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtggaacagcagcaatgtggtattcggcggagggaccaagctgaccgtccta

SEQ ID NO: 27812 - protein, 106 aa, Artificial Sequence
  Description of Artificial Sequence: Synthetic polypeptide
SYELTQPPSVSVSPGQTASITCSGDKLGDKYVCWYQQKPGQSPVLVIYQDSKRPSGIPERFSGSNSGNTATLTISGTQAMDEADYYCQAWNSSNVVFGGGTKLTVL

SEQ ID NO: 27813 - DNA, 324 bp, Artificial Sequence
  Description of Artificial Sequence: Synthetic polynucleotide
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgtaactcaacagacagcagtggtaatcatgtggtattcggcggagggaccaagctgaccgtccta

SEQ ID NO: 27814 - protein, 108 aa, Artificial Sequence
  Description of Artificial Sequence: Synthetic polypeptide
SYELTQPPSVSVSPGQTARITCSGDALPKKYAYWYQQKSGQAPVLVIYEDSKRPSGIPERFSGSSSGTMATLTISGAQVEDEADYYCNSTDSSGNHVVFGGGTKLTVL

SEQ ID NO: 27815 - DNA, 321 bp, Artificial Sequence
  Description of Artificial Sequence: Synthetic polynucleotide
gacatccagatgacccagtctccatcctcgctgtctgcatctgtaggagacagagtcaccatcacttgtcgggcgagtcagggcattaacaattatttagcctggtttcagcagaaaccaggggaagcccctaagtccctgatctatgctgcatccagtttgcgaagtggggtcccatcacagttcagcggcagtggatctggaacagatttcattctcaccatcagcagcctgcagcctgaagattttgcaacttattactgccaacagtattatagttacccattcactttcggccctgggaccaaagtggatatcaaa

SEQ ID NO: 27816 - protein, 107 aa, Artificial Sequence
  Description of Artificial Sequence: Synthetic polypeptide
DIQMTQSPSSLSASVGDRVTITCRASQGINNYLAWFQQKPGEAPKSLIYAASSLRSGVPSQFSGSGSGTDFILTISSLQPEDFATYYCQQYYSYPFTFGPGTKVDIK

SEQ ID NO: 27817 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaacgatttaggctggtatcagcagaaaccagggaaagcccctaagcgcctgatctatggtgcatccagtttgcaaagtggggtcccatcaagattcagcggcagtggatctgggacagaattcactctcacaatcagcagcctgcagcctgaagattttgcagcttattactgtctacagcgtgatagttacccgttcactttcggcggagggaccaaggtggagatcaaa

SEQ ID NO: 27818 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYGASSLQSGVPSRFSGSGSGTEFTLTISSLQPEDFAAYYCLQRDSYPFTFGGGTKVEIK

SEQ ID NO: 27819 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagccattatttagcctggtttcagcagaaaccagggaaagcccctcagtccctgatgtctgctgcatccggtttgcaaagtggggtcccttcaaagttcagcggcagtggatctgggacagatttcactctcaccatcagcagcctgcagcctgaagattttgcaacttactactgtcaacaatatcagaattaccccttcactttcggccctgggaccaaagtggatatcaaa

SEQ ID NO: 27820 - protein, 107 aa, Artificial Sequence
  Description of Artificial Sequence: Synthetic polypeptide
DIQMTQSPSSLSASVGDRVTITCRASQGISHYLAWFQQKPGKAPQSLMSAASGLQSGVPSKFSGSGSGTDFTLTISSLQPEDFATYYCQQYQNYPFTFGPGTKVDIK

SEQ ID NO: 27821 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttatgaggtttctaactgggactctggggtcccaaacagattcagcggcagtgggtcaggcactgatttcacactgaaaatcagtgcggtggaggctgaggatgttggggtttattactgcgtgcaaggtacacactggcctcggacgttcggccaagggaccaaggtggaaatcaaa

SEQ ID NO: 27822 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYEVSNWDSGVPNRFSGSGSGTDFTLKISAVEAEDVGVYYCVQGTHWPRTFGQGTKVEIK

SEQ ID NO: 27823 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttagcaacgacttagcctggtaccagcagaaacctggccaggctcccaggctcctcatctatggtgcatccaccagggccactggtatcccagccaggttcagtggcggtgggtctgggacagagttcactctcaccatcagcgccctgcagtctgaacattttgcagtttattactgtcagcagtatagtaactggccattcactttcggccctgggaccaaagtggatatcaaa

SEQ ID NO: 27824 - protein, 107 aa, Artificial Sequence
  Description of Artificial Sequence: Synthetic polypeptide
EIVMTQSPATLSVSPGERATLSCRASQSVSNDLAWYQQKPGQAPRLLIYGASTRATGIPARFSGGGSGTEFTLTISALQSEHFAVYYCQQYSNWPFTFGPGTKVDIK

SEQ ID NO: 27825 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattaccagctatttaaattggtatcagcagaaaccagggaaagtccctaagctcctgatctctactgcatccagtttgcaaagtggggtcccatcaaggttcagtggcagtggatctgggacagatttcactctcaccatcagcagtctgcaacctgaagattttgcaacttactactgtcaacagagtcacagtttcccattcactttcggccctgggaccaatgtggatttcaaa

SEQ ID NO: 27826 - protein, 107 aa, Artificial Sequence
  Description of Artificial Sequence: Synthetic polypeptide
DIQMTQSPSSLSASVGDRVTITCRASQSITSYLNWYQQKPGKVPKLLISTASSLQSGVPSRFSGSGSGTDFTLTISSLQPEDFATYYCQQSHSFPFTFGPGTNVDFK

SEQ ID NO: 27827 - DNA, 321 bp, Artificial Sequence
  Description of Artificial Sequence: Synthetic polynucleotide
gacattcagatgacccagtctccatcttccgtgtatgcatctgtaggagacagagtcaccatcacttgtcgtgcgagtcagggtattagcagctacttagcctggtatcagcagaaaccagggaaagcccctaagctcctgatctatgctgcatccagtttgcaaagtggggtcccatcaagattcagcggcagtgggtctgggacagatttcactctcaccatcagcagcctgcagcctgaagattttgcaacttactattgtcaacaggctaacagtttcccgctcactttcggcggagggaccaaggtggagatcaaa

SEQ ID NO: 27828 - protein, 107 aa, Artificial Sequence
  Description of Artificial Sequence: Synthetic polypeptide
DIQMTQSPSSVYASVGDRVTITCRASQGISSYLAWYQQKPGKAPKLLIYAASSLQSGVPSRFSGSGSGTDFTLTISSLQPEDFATYYCQQANSFPLTFGGGTKVEIK

SEQ ID NO: 27829 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaa

SEQ ID NO: 27830 - protein, 107 aa, Artificial Sequence
  Description of Artificial Sequence: Synthetic polypeptide
DIQMTQSPSSVSASVGDRVTITCRASQGISRWLAWYQQKPGKAPKLLIYAASSLQSGVPSRFSGSGSGTDFTLTISSLQPEDFATYYCQQANSFPFTFGPGTKVDIK

SEQ ID NO: 27831 - DNA, 336 bp, Artificial Sequence
  Description of Artificial Sequence: Synthetic polynucleotide
gatattgtgatgattcagtctccactctccctgcccgtcacccctggagagccggcctccatctcctgcaggtctagtcagagcctcctgcatagtaatggacacaactatttggattggtacctacagaagccagggcggtctccacagctcttgatctatttgggttctaatcgggcctccggggtccctgagaggttcagtggcagtggatcaggcacagattttacactgaaaatcagcagagtggaggctgaggatgttggggtttattactgcatgcaacctctacaaactccgttcactttcggcggagggaccaaggtggagatcaaa

SEQ ID NO: 27832 - protein, 112 aa, Artificial Sequence
  Description of Artificial Sequence: Synthetic polypeptide
DIVMIQSPLSLPVTPGEPASISCRSSQSLLHSNGHNYLDWYLQKPGRSPQLLIYLGSNRASGVPERFSGSGSGTDFTLKISRVEAEDVGVYYCMQPLQTPFTFGGGTKVEIK

SEQ ID NO: 27833 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggtcgctcactttcggcggagggaccaaggtggagatcaaa

SEQ ID NO: 27834 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWSLTFGGGTKVEIK

SEQ ID NO: 27835 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggttgctcactttcggcggagggaccaaggtggagatcaaa

SEQ ID NO: 27836 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWLLTFGGGTKVEIK

SEQ ID NO: 27837 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctccttgaattggtttcagcagaggccaggccaatctccaaggcgcctaatttataaggtttctaactgggactctggggtcccagtcagattcagcggcagtgggtcaggcactgatttcacactgaaaatcagcagggtggaggctgaggatgttgggatttattactgcatgcaaggtacacactggcctcccactttcggcggagggaccaaggtggagatcaaa

SEQ ID NO: 27838 - protein, 112 aa, Artificial Sequence
  Description of Artificial Sequence: Synthetic polypeptide
DVVMTQSPLSLPVTLGQPASISCRSSQSLVYSDGNTSLNWFQQRPGQSPRRLIYKVSNWDSGVPVRFSGSGSGTDFTLKISRVEAEDVGIYYCMQGTHWPPTFGGGTKVEIK

SEQ ID NO: 27839 - DNA, 336 bp, Artificial Sequence
  Description of Artificial Sequence: Synthetic polynucleotide
gatgttgtgatgagtcagtatccactctccctgcccgtcacctttggacagccggcctccatctcatgcaggtctagtcaaagcctcgtatacagtgatggaaacacctccttgaattggtttcagcagaggccaggccaatatccaaggcgcttaatttataaggtttctaactgggactatggggtcccagtcagattcagcggcagtgggtcaggcactgatttcacactgaaaatcagcagggtggaggctgaggatgttgggatttattactgcatgcaaggtacacactggcctcccactttcggcggagggaccaaggtggagatcaaa

SEQ ID NO: 27840 - protein, 112 aa, Artificial Sequence
  Description of Artificial Sequence: Synthetic polypeptide
DVVMSQYPLSLPVTFGQPASISCRSSQSLVYSDGNTSLNWFQQRPGQYPRRLIYKVSNWDYGVPVRFSGSGSGTDFTLKISRVEAEDVGIYYCMQGTHWPPTFGGGTKVEIK

SEQ ID NO: 27841 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaagccagggaaagcccctaagtccctgatctctgctgcatccagtttgcaaagtggggtcccatcaaagttcagcggcagtggatctgggacagatttcactctcaccatcagcagcctgcagcctgaagattttgcaacttattactgccaacagtataatagttacccgctcagtttcggcggagggaccaaggtggagatcaaa

SEQ ID NO: 27842 - protein, 107 aa, Artificial Sequence
  Description of Artificial Sequence: Synthetic polypeptide
DIQMTQSPSSLSASVGDRVTITCRASQGISNYLAWFQQKPGKAPKSLISAASSLQSGVPSKFSGSGSGTDFTLTISSLQPEDFATYYCQQYNSYPLSFGGGTKVEIK

SEQ ID NO: 27843 - DNA, 321 bp, Artificial Sequence
  Description of Artificial Sequence: Synthetic polynucleotide
gacatccagatgacccagtctccatcctcactggctgcatctgtaggagacagagtcaccatcacttgtcgggcgagtcaggacattagcaattatttagcctggtttcagcagaaaccagggaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtgtgatagtttccctctcactttcggcggagggaccaaggtggagatcaaa

SEQ ID NO: 27844 - protein, 107 aa, Artificial Sequence
  Description of Artificial Sequence: Synthetic polypeptide
DIQMTQSPSSLAASVGDRVTITCRASQDISNYLAWFQQKPGKAPKSLIYAASSLQSGVPSRFSGSGSGTDFTLTISSLQPEDFATYYCQQCDSFPLTFGGGTKVEIK

SEQ ID NO: 27845 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctattatcagcagaaaccagggaaagcccctaagcgcctgatctatgttgcatccggtttgcaaagtggggtcccatcaaggttcagcggcagtggatctgggacagaattcactctcacaatcagcagcctgcagcctgaagattttgcaacttattactgtctacagcacaatagttaccctccgtggacgttcggccaagggaccaaggtggatatcaaa

SEQ ID NO: 27846 - protein, 108 aa, Artificial Sequence
  Description of Artificial Sequence: Synthetic polypeptide
DIQMTQSPSSLSASVGDRVTITCRASQGIRNDLGYYQQKPGKAPKRLIYVASGLQSGVPSRFSGSGSGTEFTLTISSLQPEDFATYYCLQHNSYPPWTFGQGTKVDIK

SEQ ID NO: 27847 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagcctggtttcagcagaagccagggaaagcccctaagtccctgatctattctgcatccagtttgcaaagtggggtcccatcaaagttcagcggcagtggatctgggacagatttcactctcaccatcagcagcctgcagcctgaagattttgcaacttattactgccaacaatctgatagttaccctctcactttcggcggagggaccaaggtggagatcaaa

SEQ ID NO: 27848 - protein, 107 aa, Artificial Sequence
  Description of Artificial Sequence: Synthetic polypeptide
DIQMTQSPSSLSASVGDRVTITCRASQDISNYLAWFQQKPGKAPKSLIYSASSLQSGVPSKFSGSGSGTDFTLTISSLQPEDFATYYCQQSDSYPLTFGGGTKVEIK

SEQ ID NO: 27849 - DNA, 321 bp, Artificial Sequence; identical to SEQ ID NO: 27847
  Description of Artificial Sequence: Synthetic polynucleotide

SEQ ID NO: 27850 - protein, 107 aa, Artificial Sequence; identical to SEQ ID NO: 27848
  Description of Artificial Sequence: Synthetic polypeptide

SEQ ID NO: 27851 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcctctcactttcggcggagggaccaaggtggagatcaaa

SEQ ID NO: 27852 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPLTFGGGTKVEIK

SEQ ID NO: 27853 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcaggacattagcaattatttagcctggtttcagcagaaaccagggaaagcccctaagtccctgatcttttctgcatccagtttgcaaagtggggtcccatcaaagttcagcggcagtggatctgggacagatttcactctcaccatcagcaacctgcagcctgaagattttgcaacttattactgccaacaatctaatagttaccctctcactttcggcggagggaccaaggtggagatcaaa

SEQ ID NO: 27854 - protein, 107 aa, Artificial Sequence
  Description of Artificial Sequence: Synthetic polypeptide
DIQMTQSPSSLSASVGDRVTITCRASQDISNYLAWFQQKPGKAPKSLIFSASSLQSGVPSKFSGSGSGTDFTLTISNLQPEDFATYYCQQSNSYPLTFGGGTKVEIK

SEQ ID NO: 27855 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagcaattatttagcctggtttcagcagaacccagggaaagcccctaagtcccttatctatgctgcatccagtttgcaaagtggggtcccatcaaagttcagcggcagtggatgtgggacagatttcactctcaccatcagcagcccgcagcctgaagatgttgcaacctattactgccaacattatcttaattaccctctcaccttcggccaagggacacgactggagattaaa

SEQ ID NO: 27856 - protein, 107 aa, Artificial Sequence
  Description of Artificial Sequence: Synthetic polypeptide
DIQMTQSPSSLSASVGDRVTITCRASQGISNYLAWFQQNPGKAPKSLIYAASSLQSGVPSKFSGSGCGTDFTLTISSPQPEDVATYYCQHYLNYPLTFGQGTRLEIK

SEQ ID NO: 27857 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaatgatttaggctggtatcagcagaaaccagcgaaagcccctaagcgcctgatctatagagcatccagtttgcaaagtggggtcccatcacgcttcagcggcagtggatctgggacagaattcactctcacaatcagcagcctgcagcctgaagattttgccgcttattactgtctacagcataatagttacccgtggacgttcggccaagggaccaaggtagagatcaaa

SEQ ID NO: 27858 - protein, 107 aa, Artificial Sequence
  Description of Artificial Sequence: Synthetic polypeptide
DIQMTQSPSSLSASVGDRVTITCRASQDIRNDLGWYQQKPAKAPKRLIYRASSLQSGVPSRFSGSGSGTEFTLTISSLQPEDFAAYYCLQHNSYPWTFGQGTKVEIK

SEQ ID NO: 27859 - DNA, 321 bp, Artificial Sequence
  Description of Artificial Sequence: Synthetic polynucleotide
gacaaccagatgacccagtctccatcctccctgtctgcatctgtaggagacagagtcaccatcacttgccgggcaagtcagaggtttagtaactatttaaattggtatcagcagaaaccagggaaagcccctaagctcctgatctatactgcatccagtttgcaaagtggggtcccatcaaggttcagtgccagtgtctctgggacagacttcactctcaccatcagcagtctgcaacctgaagattttgcaacttattactgtcaacagagttacagtattccgctcactttcggcggagggaccaaggtggagatcaaa

SEQ ID NO: 27860 - protein, 107 aa, Artificial Sequence
  Description of Artificial Sequence: Synthetic polypeptide
DNQMTQSPSSLSASVGDRVTITCRASQRFSNYLNWYQQKPGKAPKLLIYTASSLQSGVPSRFSASVSGTDFTLTISSLQPEDFATYYCQQSYSIPLTFGGGTKVEIK

SEQ ID NO: 27861 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagacatgatttaggctggtatcagcagaaaccagggaaagcccctaagcgcctgatctttgctgcatccagtttgcaaagtggggtcccatctagattcagcggcagtggatctgggacagaattcactctcacaatcagcagcctgcagcctgaagattttgcaacttattactgtctacagcattatagtttccctcggacgttcggccaagggaccaaggtggaaatcaaa

SEQ ID NO: 27862 - protein, 107 aa, Artificial Sequence
  Description of Artificial Sequence: Synthetic polypeptide
DIQMTQSPSSLSASVGDRVTITCRASQGIRHDLGWYQQKPGKAPKRLIFAASSLQSGVPSRFSGSGSGTEFTLTISSLQPEDFATYYCLQHYSFPRTFGQGTKVEIK

SEQ ID NO: 27863 - DNA, 321 bp, Artificial Sequence
  Description of Artificial Sequence: Synthetic polynucleotide
gacatccagatgacccagtctccatcctcccgttttgcatttgtaggagacagagtcaccatcacttgccgggcaagtcagggcattagacatgatttaggctggtatcagcagaaaccagggaaagcccttaagcgcttgatatatgctgcatccagttcgcaaagtggggtcccatcaaggttcagcggcagtggatgtgggacagaattcactctcacaatcagcagcgtgcagcgcgaagattttgcaaattattactgtgtacagcattatagtttccctcggacgttcggccaagggaccaaggtggaaatcaaa

SEQ ID NO: 27864 - protein, 107 aa, Artificial Sequence
  Description of Artificial Sequence: Synthetic polypeptide
DIQMTQSPSSRFAFVGDRVTITCRASQGIRHDLGWYQQKPGKALKRLIYAASSSQSGVPSRFSGSGCGTEFTLTISSVQREDFANYYCVQHYSFPRTFGQGTKVEIK

SEQ ID NO: 27865 - DNA, 333 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctcatttataaggtttctaactgggactctggggtcccagacagaatcagcggcagtgggtcaggcactgatttcacactgaaaatcagcagggtggaggctgaggatgttgggatttattactgcatgcaaggtgcacactggttcaccttcggccaagggacacgactggagattaaa

SEQ ID NO: 27866 - protein, 111 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRISGSGSGTDFTLKISRVEAEDVGIYYCMQGAHWFTFGQGTRLEIK

SEQ ID NO: 27867 - DNA, 321 bp, Artificial Sequence
  Description of Artificial Sequence: Synthetic polynucleotide
gacatccagatgacccagtctccatcctccctgtctgcatctataggagacagagtcaccatcacttgccaggcgagtcaggacattttcaactatttaaattggtatcagcagaaaccagggaaagcccctaagctcctgatctacgatgcatccactttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaa

SEQ ID NO: 27868 - protein, 107 aa, Artificial Sequence
  Description of Artificial Sequence: Synthetic polypeptide
DIQMTQSPSSLSASIGDRVTITCQASQDIFNYLNWYQQKPGKAPKLLIYDASTLETGVPSRFSGSGSGTDFTFTISSLQPEDIATYYCQQYDNLPITFGQGTRLEIK

SEQ ID NO: 27869 - DNA, 336 bp, Artificial Sequence; identical to SEQ ID NO: 25765
  Description of Artificial Sequence: Synthetic polynucleotide

SEQ ID NO: 27870 - protein, 112 aa, Artificial Sequence; identical to SEQ ID NO: 25766
  Description of Artificial Sequence: Synthetic polypeptide

SEQ ID NO: 27871 - DNA, 324 bp, Artificial Sequence
  Description of Artificial Sequence: Synthetic polynucleotide
gaatttatgttgacgcagtctccaggcaccctgtattggtctccaggggaaagagccaccatctcgagcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 27872 - protein, 108 aa, Artificial Sequence
  Description of Artificial Sequence: Synthetic polypeptide
EFMLTQSPGTLYWSPGERATISSRASQSVSSSYLVWYQQKPGQAPRLLIYGASTRATGIPDRFSGSGSGTDFTLTISRLEPEYFAVYYCQQYGCSPLTFGGGTKVEIT

SEQ ID NO: 27873 - DNA, 324 bp, Artificial Sequence
  Description of Artificial Sequence: Synthetic polynucleotide
gaaattgtgttgacgcagtctccaggcacccggtatttgtctccaggggaaagagccaccctctcatgcagggccagtcagagtgtttacagcagctacttagcctggtaccagcagaaacctggccaggctcccaggctcctcatctatggtgcatccagccgggccactggcatcccagacaggttcagtggcagtgggtctgggacagacttcgctctcaccatcagcagactggagcctgaagattgtgcagtgtattactgtcagcactatgataactcaccgtggacgttcggccgagggaccaaggtggaaatcaaa

SEQ ID NO: 27874 - protein, 108 aa, Artificial Sequence
  Description of Artificial Sequence: Synthetic polypeptide
EIVLTQSPGTRYLSPGERATLSCRASQSVYSSYLAWYQQKPGQAPRLLIYGASSRATGIPDRFSGSGSGTDFALTISRLEPEDCAVYYCQHYDNSPWTFGRGTKVEIK

SEQ ID NO: 27875 - DNA, 321 bp, Artificial Sequence
  Description of Artificial Sequence: Synthetic polynucleotide
gacatccagatgacccagtctccgtcttccgtgtctgcttctgtaggagacagagtcatcatcacttgtcgggcgagtcagggcattagcatctggttagcctggtatcagcagaaaccagggaaagcccctaagctcctgatctatgctgcatccagtttgcaaagtggggtcccattaaggttcagcggcagtggatctgggacagatttcactctcaccatcagcagcctgcagcctgaagattttgcaacttactattgtcaacaggctaaaagtttcccgctcactttcggcggagggaccaaggtggagatcaaa

SEQ ID NO: 27876 - protein, 107 aa, Artificial Sequence
  Description of Artificial Sequence: Synthetic polypeptide
DIQMTQSPSSVSASVGDRVIITCRASQGISIWLAWYQQKPGKAPKLLIYAASSLQSGVPLRFSGSGSGTDFTLTISSLQPEDFATYYCQQAKSFPLTFGGGTKVEIK

SEQ ID NO: 27877 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcatcatttatggtgcatccagccggtccactggcataccagacaggttcagtggcagtgggtgtgggacagacttcgctctcaccatcagcagagtggagcatgaagattgtgcagtgtattactgtcagcactatgataactcaccgtggacgttcggccaagggaccaaggtggaaatcaaa

SEQ ID NO: 27878 - protein, 108 aa, Artificial Sequence
  Description of Artificial Sequence: Synthetic polypeptide
EIVLTQSPGTLYLSPGERATLSCRASQSVYSSYLAWYQQKPGQAPRLIIYGASSRSTGIPDRFSGSGCGTDFALTISRVEHEDCAVYYCQHYDNSPWTFGQGTKVEIK

SEQ ID NO: 27879 - DNA, 324 bp, Artificial Sequence
  Description of Artificial Sequence: Synthetic polynucleotide
gaaattgtgttgacgcagtctccaggcaccctgtatttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtgtgggacagacttcgctctcaccatcagcagactggagcatgaagattttgcagtgtattactgtcagcactatgataactcaccgtggacgttcggccaagggaccaaggtggaaatcaaa

SEQ ID NO: 27880 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGCGTDFALTISRLEHEDFAVYYCQHYDNSPWTFGQGTKVEIK

SEQ ID NO: 27881 - DNA, 324 bp, Artificial Sequence
  Description of Artificial Sequence: Synthetic polynucleotide
gaaatagtgatgacgcagtctccagccaccctgtttgtgtctccaggggaaagagccaccctctcctgcagggccagtcagagtgttagcagaaatttagcctggttccagcagaaacctggccaggctcccaggctcctcttttatggtgcatccatcagggccactggtatcccagccaggttcagtggcagtgggtctgggacagagttcactctcaccatctacagcctgcagtatgaagattttgcagtttattactgtcagcagtataataactggcctccgctcactttcggcggagggaccaaggtggagatcaaa

SEQ ID NO: 27882 - protein, 108 aa, Artificial Sequence
  Description of Artificial Sequence: Synthetic polypeptide
EIVMTQSPATLFVSPGERATLSCRASQSVSRNLAWFQQKPGQAPRLLFYGASIRATGIPARFSGSGSGTEFTLTIYSLQYEDFAVYYCQQYNNWPPLTFGGGTKVEIK

SEQ ID NO: 27883 - DNA, 324 bp, Artificial Sequence
  Description of Artificial Sequence: Synthetic polynucleotide
gaaattgcgttgacgcagtctccaggcaccctgtctttgtctccaggggaaagagccaccctctcctgcagggccagtccgagtgttgacagcagctacttagcctggtaccagcagaaacctggccaggctcccaggctcctcatctatggtgcatccagcagggcccctggcatcccagacaggttcagtggcagtgggtctgggacagacttcactctcaccatcagcagactggagcctgaagattttgcagtgtattactgtcagcagtatgaaagttcaccgtggacgttcggccaagggaccaaggtggaaatcaaa

SEQ ID NO: 27884 - protein, 108 aa, Artificial Sequence
  Description of Artificial Sequence: Synthetic polypeptide
EIALTQSPGTLSLSPGERATLSCRASPSVDSSYLAWYQQKPGQAPRLLIYGASSRAPGIPDRFSGSGSGTDFTLTISRLEPEDFAVYYCQQYESSPWTFGQGTKVEIK

SEQ ID NO: 27885 - DNA, 324 bp, Artificial Sequence
  Description of Artificial Sequence: Synthetic polynucleotide
gaaattgtgttgacgcagtctccaggcaccctgtatttgtctccaggggaaagagccaccctgtcatgcagggccagtcagagtgtttacagcagctacttagcctggtaccagcagaaacctggccaggctcccaggctcctcatttatggtgcatccagccgggccactggcatcccagacaggttcagtggcagtgggtctgggacagacttcgctctcaccatcagcagagtggagcctgaagattgtgcagtgtattactgtcagcactatgataactcaccgtggacgttcggccaagggaccaaggtggaaatcaaa

SEQ ID NO: 27886 - protein, 108 aa, Artificial Sequence
  Description of Artificial Sequence: Synthetic polypeptide
EIVLTQSPGTLYLSPGERATLSCRASQSVYSSYLAWYQQKPGQAPRLLIYGASSRATGIPDRFSGSGSGTDFALTISRVEPEDCAVYYCQHYDNSPWTFGQGTKVEIK

SEQ ID NO: 27887 - DNA, 321 bp, Artificial Sequence
  Description of Artificial Sequence: Synthetic polynucleotide
gacattcagatgacccaatctccatcctcccggtatgcatctgtaggagacagagtcaccatcaatagccgggcaagtcagggcataagaaatgatttaggctggtatcaacagaaaccagggaaatcccctcagcgcctgatttatgatgcatccagtttgcaaagtggggtcccatcaaggttcagcggcagtggatctgggacagaattcactctcacaatcagcagcgtgcagcctgaagattttggtgtttattactgtatacagcatagtaattacccgctcactttcggcggagggaccaaggtggagatcaaa

SEQ ID NO: 27888 - protein, 107 aa, Artificial Sequence
  Description of Artificial Sequence: Synthetic polypeptide
DIQMTQSPSSRYASVGDRVTINSRASQGIRNDLGWYQQKPGKSPQRLIYDASSLQSGVPSRFSGSGSGTEFTLTISSVQPEDFGVYYCIQHSNYPLTFGGGTKVEIK

SEQ ID NO: 27889 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccggtccactggcatcccagacaggttcagtggcagtgggtgtgggacagacttcgctctcaccatcagcagactggagcctgaagattttgcagtgtattactgtcagcactctgataactcaccgtggacgttcggccaagggaccaaggtggaaatcaaa

SEQ ID NO: 27890 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRSTGIPDRFSGSGCGTDFALTISRLEPEDFAVYYCQHSDNSPWTFGQGTKVEIK

SEQ ID NO: 27891 - DNA, 339 bp, Artificial Sequence
  Description of Artificial Sequence: Synthetic polynucleotide
gacatcgtgatgacccagtctccagacttcctggctgtgtctctgggcgagagggccaccaccaattgtaagtccagccagagtgttttacacaggtccaacaattacaactacttagcgtggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaa

SEQ ID NO: 27892 - protein, 113 aa, Artificial Sequence
  Description of Artificial Sequence: Synthetic polypeptide
DIVMTQSPDFLAVSLGERATTNCKSSQSVLHRSNNYNYLAWYQQKPGQPPKLLIYWASTRESGVPDRFSGSGSGTDFTLTISSLQAEDVAVYYCQQYYSTPPTFGQGTKVEIK

SEQ ID NO: 27893 - DNA, 339 bp, Artificial Sequence
  Description of Artificial Sequence: Synthetic polynucleotide
gacatcgtgatgacccagtgtccagactccccggctgtgtctctgggcgagagggcctccatcaattgcaagtccagccagagtattttacacagctccaacaattacaattacttagcttggtaccagcagaaaccaggacatcctcataagctgctcatttactgggcatctacccgggaatccggggtccctgaccgattcagtggcagcgggtatgggacagatttcactctaaccatcagcagcctgcaggctgaagatgtggcagtttattactgtcagcaatattatagtactccgtggacgttcggccaagggaccaaggtggaaatcaaa

SEQ ID NO: 27894 - protein, 113 aa, Artificial Sequence
  Description of Artificial Sequence: Synthetic polypeptide
DIVMTQCPDSPAVSLGERASINCKSSQSILHSSNNYNYLAWYQQKPGHPHKLLIYWASTRESGVPDRFSGSGYGTDFTLTISSLQAEDVAVYYCQQYYSTPWTFGQGTKVEIK

SEQ ID NO: 27895 - DNA, 339 bp, Artificial Sequence; identical to SEQ ID NO: 25719
  Description of Artificial Sequence: Synthetic polynucleotide

SEQ ID NO: 27896 - protein, 113 aa, Artificial Sequence; identical to SEQ ID NO: 25720
  Description of Artificial Sequence: Synthetic polypeptide

SEQ ID NO: 27897 - DNA, 324 bp, Artificial Sequence
  Description of Artificial Sequence: Synthetic polynucleotide
gaaattgtgttgacgcagtctccaggcaccctgtctttgtctccaggggaaagagccaccctctcatgcagggccagtcagagtgtttacagcagctacttagcctggtaccagcagaaacctggccaggctcccaggctcctcatttatggtgcatccagccgggccactggcatcccagacaggttcagtggcagtgggtgtgggacagacttcgctctcaccatcagcagactggagcctgaagattttgcagtgtattactgtcagcattatgataactcaccgtggacgttcggccaagggaccaaggtggaaatcaaa

SEQ ID NO: 27898 - protein, 108 aa, Artificial Sequence
  Description of Artificial Sequence: Synthetic polypeptide
EIVLTQSPGTLSLSPGERATLSCRASQSVYSSYLAWYQQKPGQAPRLLIYGASSRATGIPDRFSGSGCGTDFALTISRLEPEDFAVYYCQHYDNSPWTFGQGTKVEIK

SEQ ID NO: 27899 - DNA, 336 bp, Artificial Sequence
  Description of Artificial Sequence: Synthetic polynucleotide
gatattgtgatgactcagtctccactctccctgcccgtcacccctggagagccggcctccatctcatgcaggtctagtcagagcctcgtgcatagtagtggatacaactatttggattggtacctgcagaagccagggcagtctccacagctcgttatctatttgggttctaatcgggcctccggggtccctgacaggttcagtggcagtggatcaggctcagattttacactgaagatcagcagagtggaggctgaggatgttggactttattactgcatgcaagctctacaccctcctctcactttcggcggagggaccaaggtggagatcaaa

SEQ ID NO: 27900 - protein, 112 aa, Artificial Sequence
  Description of Artificial Sequence: Synthetic polypeptide
DIVMTQSPLSLPVTPGEPASISCRSSQSLVHSSGYNYLDWYLQKPGQSPQLVIYLGSNRASGVPDRFSGSGSGSDFTLKISRVEAEDVGLYYCMQALHPPLTFGGGTKVEIK

SEQ ID NO: 27901 - DNA, 324 bp, Artificial Sequence
  Description of Artificial Sequence: Synthetic polynucleotide
gaatttatgttgacgcagtctccaggcaccctgtctttgtctccaggggaaagagccaccctctcctgcagggccagtcagagtgttagcagcagctacttagtctggtatcagcagaaacctggccaggctcccaggctcctcatctatggtgcatccaccagggccactggcatcccagacaggttcagtggcagtgggtctgggacagacttcactctcaccatcagcagactggagcctgaatattttgcagtttattactgtcagcagtatggttgctcaccgctcactttcggcggagggaccaaggtggagatcaca

SEQ ID NO: 27902 - protein, 108 aa, Artificial Sequence; identical to SEQ ID NO: 25746
  Description of Artificial Sequence: Synthetic polypeptide

SEQ ID NO: 27903 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaataagaactacttaacttggtaccagcagaaaccaggacagcctcataagctgctcatttactgggcatctactcgggaatccggggtccctgaccgattcagtggcagcgggtctgggacagatttcagtctcacgatcggcagcctgcaggctgaagatgtggcagtttattactgtcagcaatattatagtattcctccgacgttcggccaagggaccaaggtggaaatcaaa

SEQ ID NO: 27904 - protein, 113 aa, Artificial Sequence
  Description of Artificial Sequence: Synthetic polypeptide
DIVMTQSPDSLAVSLGERATINCKSSQSVLHSSNNKNYLTWYQQKPGQPHKLLIYWASTRESGVPDRFSGSGSGTDFSLTIGSLQAEDVAVYYCQQYYSIPPTFGQGTKVEIK

SEQ ID NO: 27905 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagttttagcagcagctacttagcctggtaccagcagaaacctggccaggctcccaggctcctcatttatggtgcatccagcagggccactggcatcccagacaggttcagtggcagtgggtctgggacagacttcactctcaccatcagcagactggagcctgaagattttgcagtgtattactgtcagcagtatggtagctcaaggacgttcggccaagggaccaaggtggaaatcaaa

SEQ ID NO: 27906 - protein, 107 aa, Artificial Sequence
  Description of Artificial Sequence: Synthetic polypeptide
EIVLTQSPGTLSLSPGERATLSCRASQSFSSSYLAWYQQKPGQAPRLLIYGASSRATGIPDRFSGSGSGTDFTLTISRLEPEDFAVYYCQQYGSSRTFGQGTKVEIK

SEQ ID NO: 27907 - DNA, 321 bp, Artificial Sequence; identical to SEQ ID NO: 27073
  Description of Artificial Sequence: Synthetic polynucleotide

SEQ ID NO: 27908 - protein, 107 aa, Artificial Sequence; identical to SEQ ID NO: 27074
  Description of Artificial Sequence: Synthetic polypeptide

SEQ ID NO: 27909 - DNA, 339 bp, Artificial Sequence; identical to SEQ ID NO: 24515
  Description of Artificial Sequence: Synthetic polynucleotide

SEQ ID NO: 27910 - protein, 113 aa, Artificial Sequence; identical to SEQ ID NO: 24516
  Description of Artificial Sequence: Synthetic polypeptide

SEQ ID NO: 27911 - DNA, 339 bp, Artificial Sequence; identical to SEQ ID NO: 24515
  Description of Artificial Sequence: Synthetic polynucleotide

SEQ ID NO: 27912 - protein, 113 aa, Artificial Sequence; identical to SEQ ID NO: 24516
  Description of Artificial Sequence: Synthetic polypeptide

SEQ ID NO: 27913 - DNA, 339 bp, Artificial Sequence; identical to SEQ ID NO: 24515
  Description of Artificial Sequence: Synthetic polynucleotide

SEQ ID NO: 27914 - protein, 113 aa, Artificial Sequence; identical to SEQ ID NO: 24516
  Description of Artificial Sequence: Synthetic polypeptide

SEQ ID NO: 27915 - DNA, 339 bp, Artificial Sequence; identical to SEQ ID NO: 24515
  Description of Artificial Sequence: Synthetic polynucleotide

SEQ ID NO: 27916 - protein, 113 aa, Artificial Sequence; identical to SEQ ID NO: 24516
  Description of Artificial Sequence: Synthetic polypeptide

SEQ ID NO: 27917 - DNA, 339 bp, Artificial Sequence
  Description of Artificial Sequence: Synthetic polynucleotide
gacatcgtgatgacccagtctccagactccctggctgtgtctctgggcgagagggccaccatcaagtgtaagtccagccagagtgttttatacagctcccacaataacaactacttagcttggtaccagcagaaaccaggacagcctcctaagttgctcctttactgggcatctacccgggaatccggggtccctgaccgattcagtggcagcgggtctgggacagaattcactctcaccatcagcagcctgcaggctgaagatgtggcagtttattactgtcagcagtattatagtactcctccgacgttcggccaagggaccaaggtggaaatcaaa

SEQ ID NO: 27918 - protein, 113 aa, Artificial Sequence
  Description of Artificial Sequence: Synthetic polypeptide
DIVMTQSPDSLAVSLGERATIKCKSSQSVLYSSHNNNYLAWYQQKPGQPPKLLLYWASTRESGVPDRFSGSGSGTEFTLTISSLQAEDVAVYYCQQYYSTPPTFGQGTKVEIK

SEQ ID NO: 27919 - DNA, 339 bp, Artificial Sequence; identical to SEQ ID NO: 27917
  Description of Artificial Sequence: Synthetic polynucleotide

SEQ ID NO: 27920 - protein, 113 aa, Artificial Sequence; identical to SEQ ID NO: 27918
  Description of Artificial Sequence: Synthetic polypeptide

SEQ ID NO: 27921 - DNA, 339 bp, Artificial Sequence; identical to SEQ ID NO: 27917
  Description of Artificial Sequence: Synthetic polynucleotide

SEQ ID NO: 27922 - protein, 113 aa, Artificial Sequence; identical to SEQ ID NO: 27918
  Description of Artificial Sequence: Synthetic polypeptide

SEQ ID NO: 27923 - DNA, 339 bp, Artificial Sequence; identical to SEQ ID NO: 27917
  Description of Artificial Sequence: Synthetic polynucleotide

SEQ ID NO: 27924 - protein, 113 aa, Artificial Sequence; identical to SEQ ID NO: 27918
  Description of Artificial Sequence: Synthetic polypeptide

SEQ ID NO: 27925 - DNA, 339 bp, Artificial Sequence
  Description of Artificial Sequence: Synthetic polynucleotide
gacatcgtgatgacccagtttccagactccctggctgtgtctctgggcgagagggccaccatcaagtgtaagtccagccagagtgttttatacagctcccacaataacaactacttagcttggtaccagcagaaaccaggacagcctcctaagttgctcctttactgggcatctacccgggaatccggggtccctgaccgattcagtggcagcgggtctgggacagaattcactctcaccatcagcagcctgcaggctgaagatgtggcagtttattactgtcagcagtattatagtactcctccgacgttcggccaagggaccaaggtggaaatcaaa

SEQ ID NO: 27926 - protein, 113 aa, Artificial Sequence
  Description of Artificial Sequence: Synthetic polypeptide
DIVMTQFPDSLAVSLGERATIKCKSSQSVLYSSHNNNYLAWYQQKPGQPPKLLLYWASTRESGVPDRFSGSGSGTEFTLTISSLQAEDVAVYYCQQYYSTPPTFGQGTKVEIK

SEQ ID NO: 27927 - DNA, 339 bp, Artificial Sequence
  Description of Artificial Sequence: Synthetic polynucleotide
gacatcgtgatgacccagtctccagactccctggctgtgtctctgggcgagagggccaccatcaactgtaagtccagccagagtgttttatacagctcccacaataacaactacttagcttggtaccagcagaaaccaggacagcctcctaagttgctcctttactgggcatctacccgggaatccggggtccctgaccgattcagtggcagcgggtctgggacagaattcactctcaccatcagcagcctggaggctgaagatgtggcagtttattactgtcagcagtattatagtactcctccgacgttcggccaagggaccaaggtggaaatcaaa

SEQ ID NO: 27928 - protein, 113 aa, Artificial Sequence
  Description of Artificial Sequence: Synthetic polypeptide
DIVMTQSPDSLAVSLGERATINCKSSQSVLYSSHNNNYLAWYQQKPGQPPKLLLYWASTRESGVPDRFSGSGSGTEFTLTISSLEAEDVAVYYCQQYYSTPPTFGQGTKVEIK

SEQ ID NO: 27929 - DNA, 339 bp, Artificial Sequence
  Description of Artificial Sequence: Synthetic polynucleotide
gacatcgtgatgacccagtctccagactccctggctgtgtctctgggcgagagggccaccatcaactgtaagtccagccagagtgttttatacagctcccacaataacaactacttagcttggtaccagcagaaaccaggacagcctcctaagttgctcctttactgggcatctacccgggaatccggggtccctgaccgattcagtggcagcgggtctgggacagaattcactctcaccatcagcagcctgcaggctgaagatgtggcagtttattactgtcagcagtattatagtactcctccgacgttcggccaagggaccaaggtggaaatcaaa

SEQ ID NO: 27930 - protein, 113 aa, Artificial Sequence
  Description of Artificial Sequence: Synthetic polypeptide
DIVMTQSPDSLAVSLGERATINCKSSQSVLYSSHNNNYLAWYQQKPGQPPKLLLYWASTRESGVPDRFSGSGSGTEFTLTISSLQAEDVAVYYCQQYYSTPPTFGQGTKVEIK

SEQ ID NO: 27931 - DNA, 339 bp, Artificial Sequence; identical to SEQ ID NO: 27929
  Description of Artificial Sequence: Synthetic polynucleotide

SEQ ID NO: 27932 - protein, 113 aa, Artificial Sequence; identical to SEQ ID NO: 27930
  Description of Artificial Sequence: Synthetic polypeptide

SEQ ID NO: 27933 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttacacagctccaacaataacaactacttagcttggttccagcagaaaccaggacagcctcctaaactgctcctttactgggcatctacccgggaatccggggtccctgaccgattcagtggcagcgggtctgggacagatttcactctcaccatcagcagcctgcagcctgaagatgtggcagtttattactgtcagcaatattatagtactccagtcactttcggccctgggaccaaagtgggtatcaaa

SEQ ID NO: 27934 - protein, 113 aa, Artificial Sequence
  Description of Artificial Sequence: Synthetic polypeptide
DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYSTPVTFGPGTKVGIK

SEQ ID NO: 27935 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttacacagctccaacaataacaactacttagcttggttccagcagaaaccaggacagcctcctaaactgctcctttactgggcatctacccgggaatccggggtccctgaccgattcagtggcagcgggtctgggacagatttcactctcaccatcagcagcctgcagcctgaagatgtggcagtttattactgtcagcaatattataatgctccagtcactttcggccctgggaccaaagtgggtatcaaa

SEQ ID NO: 27936 - protein, 113 aa, Artificial Sequence
  Description of Artificial Sequence: Synthetic polypeptide
DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYNAPVTFGPGTKVGIK

SEQ ID NO: 27937 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttacacagctccaacaataacaactacttagcttggttccagcagaaaccaggacagcctcctaaactgctcctttactgggcatctacccgggaatccggggtccctgaccgattcagtggcagcgggtctgggacagatttcactctcaccatcagcagcctgcagcctgaagatgtggcagtttattactgtcagcaatattatcaaactccagtcactttcggccctgggaccaaagtgggtatcaaa

SEQ ID NO: 27938 - protein, 113 aa, Artificial Sequence
  Description of Artificial Sequence: Synthetic polypeptide
DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYQTPVTFGPGTKVGIK

SEQ ID NO: 27939 - DNA, 339 bp, Artificial Sequence; identical to SEQ ID NO: 25163
  Description of Artificial Sequence: Synthetic polynucleotide

SEQ ID NO: 27940 - protein, 113 aa, Artificial Sequence; identical to SEQ ID NO: 25164
  Description of Artificial Sequence: Synthetic polypeptide

SEQ ID NO: 27941 - DNA, 339 bp, Artificial Sequence; identical to SEQ ID NO: 25163
  Description of Artificial Sequence: Synthetic polynucleotide

SEQ ID NO: 27942 - protein, 113 aa, Artificial Sequence; identical to SEQ ID NO: 25164
  Description of Artificial Sequence: Synthetic polypeptide

SEQ ID NO: 27943 - DNA, 339 bp, Artificial Sequence; identical to SEQ ID NO: 25163
  Description of Artificial Sequence: Synthetic polynucleotide

SEQ ID NO: 27944 - protein, 113 aa, Artificial Sequence; identical to SEQ ID NO: 25164
  Description of Artificial Sequence: Synthetic polypeptide

SEQ ID NO: 27945 - DNA, 339 bp, Artificial Sequence; identical to SEQ ID NO: 27933
  Description of Artificial Sequence: Synthetic polynucleotide

SEQ ID NO: 27946 - protein, 113 aa, Artificial Sequence; identical to SEQ ID NO: 27934
  Description of Artificial Sequence: Synthetic polypeptide

SEQ ID NO: 27947 - DNA, 339 bp, Artificial Sequence; identical to SEQ ID NO: 27933
  Description of Artificial Sequence: Synthetic polynucleotide

SEQ ID NO: 27948 - protein, 113 aa, Artificial Sequence; identical to SEQ ID NO: 27934
  Description of Artificial Sequence: Synthetic polypeptide

SEQ ID NO: 27949 - DNA, 339 bp, Artificial Sequence; identical to SEQ ID NO: 27935
  Description of Artificial Sequence: Synthetic polynucleotide

SEQ ID NO: 27950 - protein, 113 aa, Artificial Sequence; identical to SEQ ID NO: 27936
  Description of Artificial Sequence: Synthetic polypeptide

SEQ ID NO: 27951 - DNA, 339 bp, Artificial Sequence; identical to SEQ ID NO: 27937
  Description of Artificial Sequence: Synthetic polynucleotide

SEQ ID NO: 27952 - protein, 113 aa, Artificial Sequence; identical to SEQ ID NO: 27938
  Description of Artificial Sequence: Synthetic polypeptide

SEQ ID NO: 27953 - DNA, 339 bp, Artificial Sequence; identical to SEQ ID NO: 27937
  Description of Artificial Sequence: Synthetic polynucleotide

SEQ ID NO: 27954 - protein, 113 aa, Artificial Sequence; identical to SEQ ID NO: 27938
  Description of Artificial Sequence: Synthetic polypeptide

SEQ ID NO: 27955 - DNA, 339 bp, Artificial Sequence; identical to SEQ ID NO: 27937
  Description of Artificial Sequence: Synthetic polynucleotide

SEQ ID NO: 27956 - protein, 113 aa, Artificial Sequence; identical to SEQ ID NO: 27938
  Description of Artificial Sequence: Synthetic polypeptide

SEQ ID NO: 27957 - DNA, 339 bp, Artificial Sequence; identical to SEQ ID NO: 27933
  Description of Artificial Sequence: Synthetic polynucleotide

SEQ ID NO: 27958 - protein, 113 aa, Artificial Sequence; identical to SEQ ID NO: 27934
  Description of Artificial Sequence: Synthetic polypeptide

SEQ ID NO: 27959 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttacacagctccaacaataacaactacttagcttggttccagcagaaaccaggacagcctcctaaactgctcctttactgggcatctacccgggaatccggggtccctgaccgattcagtggcagcgggtctgggacagatttcactctcaccatcagcagcctgcagcctgaagatgtggcagtttattactgtcagcaatattatagtactccagtcactttcggccaagggaccaaagtggaaatcaaa

SEQ ID NO: 27960 - protein, 113 aa, Artificial Sequence
  Description of Artificial Sequence: Synthetic polypeptide
DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYSTPVTFGQGTKVEIK

SEQ ID NO: 27961 - DNA, 339 bp, Artificial Sequence; identical to SEQ ID NO: 27933
  Description of Artificial Sequence: Synthetic polynucleotide

SEQ ID NO: 27962 - protein, 113 aa, Artificial Sequence; identical to SEQ ID NO: 27934
  Description of Artificial Sequence: Synthetic polypeptide

SEQ ID NO: 27963 - DNA, 339 bp, Artificial Sequence; identical to SEQ ID NO: 27959
  Description of Artificial Sequence: Synthetic polynucleotide

SEQ ID NO: 27964 - protein, 113 aa, Artificial Sequence; identical to SEQ ID NO: 27960
  Description of Artificial Sequence: Synthetic polypeptide

SEQ ID NO: 27965 - DNA, 339 bp, Artificial Sequence; identical to SEQ ID NO: 27959
  Description of Artificial Sequence: Synthetic polynucleotide

SEQ ID NO: 27966 - protein, 113 aa, Artificial Sequence; identical to SEQ ID NO: 27960
  Description of Artificial Sequence: Synthetic polypeptide

SEQ ID NO: 27967 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtattttacacagctccaacaataacaactacttagcttggttccagcagaaaccaggacagcctcctaaactgctcctttactgggcatctacccgggaatccggggtccctgaccgattcagtggcagcgggtctgggacagatttcactctcaccatcagcagcctgcagcctgaagatgtggcagtttattactgtcagcaatattataatactccagtcactttcggccctgggaccaaagtggaaatcaaa

SEQ ID NO: 27968 - protein, 113 aa, Artificial Sequence
  Description of Artificial Sequence: Synthetic polypeptide
DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYNTPVTFGPGTKVEIK

SEQ ID NO: 27969 - DNA, 321 bp, Artificial Sequence; identical to SEQ ID NO: 24929
  Description of Artificial Sequence: Synthetic polynucleotide

SEQ ID NO: 27970 - protein, 107 aa, Artificial Sequence; identical to SEQ ID NO: 24930
  Description of Artificial Sequence: Synthetic polypeptide

SEQ ID NO: 27971 - DNA, 321 bp, Artificial Sequence
  Description of Artificial Sequence: Synthetic polynucleotide
gacatccagatgacccagtctccatcttccgtgtctgcatctgtaggagatagagtcaccatcacttgtcgggcgagtcagggtattagcaggtggttagcctggtatcagcagaaaccagggaaagcccctaagctcctgatctatggtgcatccagtttgcaaagtggggtcccatcaaggttcagcggcagtggatctgggacagatttcactctcaccatcagcagcctgcagcctgaagattttgcaatttattattgtcaacaggctaacagtttcccattcactttcggccaagggaccaaagtggatatcaaa

SEQ ID NO: 27972 - protein, 107 aa, Artificial Sequence
  Description of Artificial Sequence: Synthetic polypeptide
DIQMTQSPSSVSASVGDRVTITCRASQGISRWLAWYQQKPGKAPKLLIYGASSLQSGVPSRFSGSGSGTDFTLTISSLQPEDFAIYYCQQANSFPFTFGQGTKVDIK

SEQ ID NO: 27973 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctatggtgcatccagtttgcaaagtggggtcccatcaaggttcagcggcagtggatctgggacagatttcactctcaccatcagcagcctgcagcctgaagattttgcaacttattattgtcaacaggctaacagtttcccattcactttcggccaagggaccaaagtggatatcaaa

SEQ ID NO: 27974 - protein, 107 aa, Artificial Sequence
  Description of Artificial Sequence: Synthetic polypeptide
DIQMTQSPSSVSASVGDRVTITCRASQGISRWLAWYQQKPGKAPKLLIYGASSLQSGVPSRFSGSGSGTDFTLTISSLQPEDFATYYCQQANSFPFTFGQGTKVDIK

SEQ ID NO: 27975 - DNA, 321 bp, Artificial Sequence; identical to SEQ ID NO: 24929
  Description of Artificial Sequence: Synthetic polynucleotide

SEQ ID NO: 27976 - protein, 107 aa, Artificial Sequence; identical to SEQ ID NO: 24930
  Description of Artificial Sequence: Synthetic polypeptide

SEQ ID NO: 27977 - DNA, 321 bp, Artificial Sequence; identical to SEQ ID NO: 24929
  Description of Artificial Sequence: Synthetic polynucleotide

SEQ ID NO: 27978 - protein, 107 aa, Artificial Sequence; identical to SEQ ID NO: 24930
  Description of Artificial Sequence: Synthetic polypeptide

SEQ ID NO: 27979 - DNA, 321 bp, Artificial Sequence; identical to SEQ ID NO: 27971
  Description of Artificial Sequence: Synthetic polynucleotide

SEQ ID NO: 27980 - protein, 107 aa, Artificial Sequence; identical to SEQ ID NO: 27972
  Description of Artificial Sequence: Synthetic polypeptide

SEQ ID NO: 27981 - DNA, 321 bp, Artificial Sequence; identical to SEQ ID NO: 27971
  Description of Artificial Sequence: Synthetic polynucleotide

SEQ ID NO: 27982 - protein, 107 aa, Artificial Sequence; identical to SEQ ID NO: 27972
  Description of Artificial Sequence: Synthetic polypeptide

SEQ ID NO: 27983 - DNA, 321 bp, Artificial Sequence; identical to SEQ ID NO: 27973
  Description of Artificial Sequence: Synthetic polynucleotide

SEQ ID NO: 27984 - protein, 107 aa, Artificial Sequence; identical to SEQ ID NO: 27974
  Description of Artificial Sequence: Synthetic polypeptide

SEQ ID NO: 27985 - DNA, 321 bp, Artificial Sequence; identical to SEQ ID NO: 25009
  Description of Artificial Sequence: Synthetic polynucleotide

SEQ ID NO: 27986 - protein, 107 aa, Artificial Sequence; identical to SEQ ID NO: 25010
  Description of Artificial Sequence: Synthetic polypeptide

SEQ ID NO: 27987 - DNA, 321 bp, Artificial Sequence; identical to SEQ ID NO: 25009
  Description of Artificial Sequence: Synthetic polynucleotide

SEQ ID NO: 27988 - protein, 107 aa, Artificial Sequence; identical to SEQ ID NO: 25010
  Description of Artificial Sequence: Synthetic polypeptide

SEQ ID NO: 27989 - DNA, 321 bp, Artificial Sequence; identical to SEQ ID NO: 25009
  Description of Artificial Sequence: Synthetic polynucleotide

SEQ ID NO: 27990 - protein, 107 aa, Artificial Sequence; identical to SEQ ID NO: 25010
  Description of Artificial Sequence: Synthetic polypeptide

SEQ ID NO: 27991 - DNA, 321 bp, Artificial Sequence; identical to SEQ ID NO: 25009
  Description of Artificial Sequence: Synthetic polynucleotide

SEQ ID NO: 27992 - protein, 107 aa, Artificial Sequence; identical to SEQ ID NO: 25010
  Description of Artificial Sequence: Synthetic polypeptide

SEQ ID NO: 27993 - DNA, 321 bp, Artificial Sequence; identical to SEQ ID NO: 25009
  Description of Artificial Sequence: Synthetic polynucleotide

SEQ ID NO: 27994 - protein, 107 aa, Artificial Sequence; identical to SEQ ID NO: 25010
  Description of Artificial Sequence: Synthetic polypeptide

SEQ ID NO: 27995 - DNA, 321 bp, Artificial Sequence; identical to SEQ ID NO: 25009
  Description of Artificial Sequence: Synthetic polynucleotide

SEQ ID NO: 27996 - protein, 107 aa, Artificial Sequence; identical to SEQ ID NO: 25010
  Description of Artificial Sequence: Synthetic polypeptide

SEQ ID NO: 27997 - DNA, 321 bp, Artificial Sequence; identical to SEQ ID NO: 25009
  Description of Artificial Sequence: Synthetic polynucleotide

SEQ ID NO: 27998 - protein, 107 aa, Artificial Sequence; identical to SEQ ID NO: 25010
  Description of Artificial Sequence: Synthetic polypeptide

SEQ ID NO: 27999 - DNA, 321 bp, Artificial Sequence; identical to SEQ ID NO: 25009
  Description of Artificial Sequence: Synthetic polynucleotide

SEQ ID NO: 28000 - protein, 107 aa, Artificial Sequence; identical to SEQ ID NO: 25010
  Description of Artificial Sequence: Synthetic polypeptide

SEQ ID NO: 28001 - DNA, 321 bp, Artificial Sequence; identical to SEQ ID NO: 25009
  Description of Artificial Sequence: Synthetic polynucleotide

SEQ ID NO: 28002 - protein, 107 aa, Artificial Sequence; identical to SEQ ID NO: 25010
  Description of Artificial Sequence: Synthetic polypeptide

SEQ ID NO: 28003 - DNA, 321 bp, Artificial Sequence; identical to SEQ ID NO: 25009
  Description of Artificial Sequence: Synthetic polynucleotide

SEQ ID NO: 28004 - protein, 107 aa, Artificial Sequence; identical to SEQ ID NO: 25010
  Description of Artificial Sequence: Synthetic polypeptide

SEQ ID NO: 28005 - DNA, 321 bp, Artificial Sequence; identical to SEQ ID NO: 25009
  Description of Artificial Sequence: Synthetic polynucleotide

SEQ ID NO: 28006 - protein, 107 aa, Artificial Sequence; identical to SEQ ID NO: 25010
  Description of Artificial Sequence: Synthetic polypeptide

SEQ ID NO: 28007 - DNA, 321 bp, Artificial Sequence; identical to SEQ ID NO: 25009
  Description of Artificial Sequence: Synthetic polynucleotide

SEQ ID NO: 28008 - protein, 107 aa, Artificial Sequence; identical to SEQ ID NO: 25010
  Description of Artificial Sequence: Synthetic polypeptide

SEQ ID NO: 28009 - DNA, 321 bp, Artificial Sequence; identical to SEQ ID NO: 25009
  Description of Artificial Sequence: Synthetic polynucleotide

SEQ ID NO: 28010 - protein, 107 aa, Artificial Sequence; identical to SEQ ID NO: 25010
  Description of Artificial Sequence: Synthetic polypeptide

SEQ ID NO: 28011 - DNA, 321 bp, Artificial Sequence; identical to SEQ ID NO: 25009
  Description of Artificial Sequence: Synthetic polynucleotide

SEQ ID NO: 28012 - protein, 107 aa, Artificial Sequence; identical to SEQ ID NO: 25010
  Description of Artificial Sequence: Synthetic polypeptide

SEQ ID NO: 28013 - DNA, 321 bp, Artificial Sequence
  Description of Artificial Sequence: Synthetic polynucleotide
gacatccagatgacccagtctccatcctccctgtctgcatctgtaggagacagagtcaccattacttgccgggcaagtcaaaacattatcagctatttaaattggtatcaacagaaaccagggaaagcccctaaattcctgatctatactgcatccagtttgcaaagtggggtcccatcaaggttcagtggcagtggatctgggacagatttcactctcaccatcagcagtctgcaacctgaagattttgcaatttactactgtcaacagacttacagtaccccgctcactttcggcggcgggaccaaggtggagatcaaa

SEQ ID NO: 28014 - protein, 107 aa, Artificial Sequence
  Description of Artificial Sequence: Synthetic polypeptide
DIQMTQSPSSLSASVGDRVTITCRASQNIISYLNWYQQKPGKAPKFLIYTASSLQSGVPSRFSGSGSGTDFTLTISSLQPEDFAIYYCQQTYSTPLTFGGGTKVEIK

SEQ ID NO: 28015 - DNA, 321 bp, Artificial Sequence
  Description of Artificial Sequence: Synthetic polynucleotide
gacatccagatgacccagtctccatcctccctgtctgcatctgtaggagacagagtcaccattacttgccgggcaagtcaaaacattatcagctatttaaattggtatcaacagaaaccagggaaagcccctaaactcctgatctatactgcatccagtttgcaaagtggggtcccatcaaggttcagtggcagtggatctgggacagatttcactctcaccatcagcagtctgcaacctgaagattttgcaacttactactgtcaacagacttacagtaccccgctcactttcggcggcgggaccaaggtggagatcaaa

SEQ ID NO: 28016 - protein, 107 aa, Artificial Sequence
  Description of Artificial Sequence: Synthetic polypeptide
DIQMTQSPSSLSASVGDRVTITCRASQNIISYLNWYQQKPGKAPKLLIYTASSLQSGVPSRFSGSGSGTDFTLTISSLQPEDFATYYCQQTYSTPLTFGGGTKVEIK

SEQ ID NO: 28017 - DNA, 321 bp, Artificial Sequence
  Description of Artificial Sequence: Synthetic polynucleotide
gacatccagatgacccagtctccatcctccctgtctgcatctgtaggagacagagtcaccattgcttgccgggcaagtcaaaacattatcagctatttaaattggtatcaacagaaaccagggaaagcccctaaattcctgatctatactgcatccagtttgcaaagtggggtcccatcaaggttcagtggcagtggatctgggacagatttcactctcaccatcagcagtctgcaacctgaagattttgcaatttactactgtcaacagacttacagtaccccgctcactttcggcggcgggaccaaggtggagatcaaa

SEQ ID NO: 28018 - protein, 107 aa, Artificial Sequence; identical to SEQ ID NO: 24908
  Description of Artificial Sequence: Synthetic polypeptide

SEQ ID NO: 28019 - DNA, 321 bp, Artificial Sequence; identical to SEQ ID NO: 28017
  Description of Artificial Sequence: Synthetic polynucleotide

SEQ ID NO: 28020 - protein, 107 aa, Artificial Sequence; identical to SEQ ID NO: 24908
  Description of Artificial Sequence: Synthetic polypeptide

SEQ ID NO: 28021 - DNA, 321 bp, Artificial Sequence; identical to SEQ ID NO: 28017
  Description of Artificial Sequence: Synthetic polynucleotide

SEQ ID NO: 28022 - protein, 107 aa, Artificial Sequence; identical to SEQ ID NO: 24908
  Description of Artificial Sequence: Synthetic polypeptide

SEQ ID NO: 28023 - DNA, 321 bp, Artificial Sequence; identical to SEQ ID NO: 28017
  Description of Artificial Sequence: Synthetic polynucleotide

SEQ ID NO: 28024 - protein, 107 aa, Artificial Sequence; identical to SEQ ID NO: 24908
  Description of Artificial Sequence: Synthetic polypeptide

SEQ ID NO: 28025 - DNA, 321 bp, Artificial Sequence; identical to SEQ ID NO: 28017
  Description of Artificial Sequence: Synthetic polynucleotide

SEQ ID NO: 28026 - protein, 107 aa, Artificial Sequence; identical to SEQ ID NO: 24908
  Description of Artificial Sequence: Synthetic polypeptide

SEQ ID NO: 28027 - DNA, 321 bp, Artificial Sequence; identical to SEQ ID NO: 28017
  Description of Artificial Sequence: Synthetic polynucleotide

SEQ ID NO: 28028 - protein, 107 aa, Artificial Sequence; identical to SEQ ID NO: 24908
  Description of Artificial Sequence: Synthetic polypeptide

SEQ ID NO: 28029 - DNA, 321 bp, Artificial Sequence; identical to SEQ ID NO: 28017
  Description of Artificial Sequence: Synthetic polynucleotide

SEQ ID NO: 28030 - protein, 107 aa, Artificial Sequence; identical to SEQ ID NO: 24908
  Description of Artificial Sequence: Synthetic polypeptide

SEQ ID NO: 28031 - DNA, 321 bp, Artificial Sequence; identical to SEQ ID NO: 28017
  Description of Artificial Sequence: Synthetic polynucleotide

SEQ ID NO: 28032 - protein, 107 aa, Artificial Sequence; identical to SEQ ID NO: 24908
  Description of Artificial Sequence: Synthetic polypeptide

SEQ ID NO: 28033 - DNA, 321 bp, Artificial Sequence; identical to SEQ ID NO: 28017
  Description of Artificial Sequence: Synthetic polynucleotide

SEQ ID NO: 28034 - protein, 107 aa, Artificial Sequence; identical to SEQ ID NO: 24908
  Description of Artificial Sequence: Synthetic polypeptide

SEQ ID NO: 28035 - DNA, 321 bp, Artificial Sequence; identical to SEQ ID NO: 28013
  Description of Artificial Sequence: Synthetic polynucleotide

SEQ ID NO: 28036 - protein, 107 aa, Artificial Sequence; identical to SEQ ID NO: 28014
  Description of Artificial Sequence: Synthetic polypeptide

SEQ ID NO: 28037 - DNA, 321 bp, Artificial Sequence; identical to SEQ ID NO: 28013
  Description of Artificial Sequence: Synthetic polynucleotide

SEQ ID NO: 28038 - protein, 107 aa, Artificial Sequence; identical to SEQ ID NO: 28014
  Description of Artificial Sequence: Synthetic polypeptide

SEQ ID NO: 28039 - DNA, 321 bp, Artificial Sequence; identical to SEQ ID NO: 28013
  Description of Artificial Sequence: Synthetic polynucleotide

SEQ ID NO: 28040 - protein, 107 aa, Artificial Sequence; identical to SEQ ID NO: 28014
  Description of Artificial Sequence: Synthetic polypeptide

SEQ ID NO: 28041 - DNA, 321 bp, Artificial Sequence; identical to SEQ ID NO: 28015
  Description of Artificial Sequence: Synthetic polynucleotide

SEQ ID NO: 28042 - protein, 107 aa, Artificial Sequence; identical to SEQ ID NO: 28016
  Description of Artificial Sequence: Synthetic polypeptide

SEQ ID NO: 28043 - DNA, 321 bp, Artificial Sequence; identical to SEQ ID NO: 28015
  Description of Artificial Sequence: Synthetic polynucleotide

SEQ ID NO: 28044 - protein, 107 aa, Artificial Sequence; identical to SEQ ID NO: 28016
  Description of Artificial Sequence: Synthetic polypeptide

SEQ ID NO: 28045 - DNA, 321 bp, Artificial Sequence; identical to SEQ ID NO: 28015
  Description of Artificial Sequence: Synthetic polynucleotide

SEQ ID NO: 28046 - protein, 107 aa, Artificial Sequence; identical to SEQ ID NO: 28016
  Description of Artificial Sequence: Synthetic polypeptide

SEQ ID NO: 28047 - DNA, 321 bp, Artificial Sequence; identical to SEQ ID NO: 28013
  Description of Artificial Sequence: Synthetic polynucleotide

SEQ ID NO: 28048 - protein, 107 aa, Artificial Sequence; identical to SEQ ID NO: 28014
  Description of Artificial Sequence: Synthetic polypeptide

SEQ ID NO: 28049 - DNA, 321 bp, Artificial Sequence; identical to SEQ ID NO: 28017
  Description of Artificial Sequence: Synthetic polynucleotide

SEQ ID NO: 28050 - protein, 107 aa, Artificial Sequence; identical to SEQ ID NO: 24908
  Description of Artificial Sequence: Synthetic polypeptide

SEQ ID NO: 28051 - DNA, 321 bp, Artificial Sequence; identical to SEQ ID NO: 28017
  Description of Artificial Sequence: Synthetic polynucleotide

SEQ ID NO: 28052 - protein, 107 aa, Artificial Sequence; identical to SEQ ID NO: 24908
  Description of Artificial Sequence: Synthetic polypeptide

SEQ ID NO: 28053 - DNA, 321 bp, Artificial Sequence; identical to SEQ ID NO: 28013
  Description of Artificial Sequence: Synthetic polynucleotide

SEQ ID NO: 28054 - protein, 107 aa, Artificial Sequence; identical to SEQ ID NO: 28014
  Description of Artificial Sequence: Synthetic polypeptide

SEQ ID NO: 28055 - DNA, 324 bp, Artificial Sequence
  Description of Artificial Sequence: Synthetic polynucleotide
gaaattgtgttgacgcagtctccaggcaccctgtctttgtttccaggggaaagagccaccctctcctgcagggccagtcagagtgtgatcagcagctacttagcctggtaccagcagaaacctggccaggctcccaggctcctcatctttggtgtatctagttgggccactggcatcccagacaggttcagtggcagtgggtctgggacagacttcactctcaccatcagcagactggagcctgaagattttgcagtgtattactgtcaacaatatggtaggtcaccattcaatttcggccctgggaccaaagtggatatcaaa

SEQ ID NO: 28056 - protein, 108 aa, Artificial Sequence
  Description of Artificial Sequence: Synthetic polypeptide
EIVLTQSPGTLSLFPGERATLSCRASQSVISSYLAWYQQKPGQAPRLLIFGVSSWATGIPDRFSGSGSGTDFTLTISRLEPEDFAVYYCQQYGRSPFNFGPGTKVDIK

SEQ ID NO: 28057 - DNA, 333 bp, Artificial Sequence
  Description of Artificial Sequence: Synthetic polynucleotide
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacaacagcctgagtggttcggtattcggcggagggaccaagctgaccgtccta

SEQ ID NO: 28058 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSGSVFGGGTKLTVL

SEQ ID NO: 28059 - DNA, 336 bp, Artificial Sequence
  Description of Artificial Sequence: Synthetic polynucleotide
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggccgctcactttcggcggagggaccaaggtggagatcaaa

SEQ ID NO: 28060 - protein, 112 aa, Artificial Sequence; identical to SEQ ID NO: 27852
  Description of Artificial Sequence: Synthetic polypeptide

SEQ ID NO: 28061 - DNA, 339 bp, Artificial Sequence; identical to SEQ ID NO: 27925
  Description of Artificial Sequence: Synthetic polynucleotide

SEQ ID NO: 28062 - protein, 113 aa, Artificial Sequence; identical to SEQ ID NO: 27926
  Description of Artificial Sequence: Synthetic polypeptide

SEQ ID NO: 28063 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctatggtgcatccagtttgcaaagtggggtcccatcaaggttcagcggcagtggatctgggacagatttcactctcaccatcagcagcctgcagcctgaagattttgcaacttattattgtcaacaggctaacagtttcccattcactttcggccctgggaccaaagtggatatcaaa

SEQ ID NO: 28064 - protein, 107 aa, Artificial Sequence
  Description of Artificial Sequence: Synthetic polypeptide
DIQMTQSPSSVSASVGDRVTITCRASQGISRWLAWYQQKPGKAPKLLIYGASSLQSGVPSRFSGSGSGTDFTLTISSLQPEDFATYYCQQANSFPFTFGPGTKVDIK

SEQ ID NO: 28065 - DNA, 321 bp, Artificial Sequence; identical to SEQ ID NO: 28017
  Description of Artificial Sequence: Synthetic polynucleotide

SEQ ID NO: 28066 - protein, 107 aa, Artificial Sequence; identical to SEQ ID NO: 24908
  Description of Artificial Sequence: Synthetic polypeptide

SEQ ID NO: 28067 - DNA, 339 bp, Artificial Sequence; identical to SEQ ID NO: 25881
  Description of Artificial Sequence: Synthetic polynucleotide

SEQ ID NO: 28068 - protein, 113 aa, Artificial Sequence; identical to SEQ ID NO: 25882
  Description of Artificial Sequence: Synthetic polypeptide

SEQ ID NO: 28069 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagactgtcttacacagctccaacaattataactacttagcttggtaccagcagaagccaggacagccccctaaggtgctcatttactggacatctacccgggaatccggggtccatgaccgattcagtggcagcgggtctgggacagatttcactctcaccatcagcagcctgcaggctgaagatgtggcagtttattactgtcaccaatatcttagtagtcctctgacgttcggccaagggaccaaggtggaaatcaaa

SEQ ID NO: 28070 - protein, 113 aa, Artificial Sequence
  Description of Artificial Sequence: Synthetic polypeptide
DIVMTQSPDSLAVSLGERATINCKSSQTVLHSSNNYNYLAWYQQKPGQPPKVLIYWTSTRESGVHDRFSGSGSGTDFTLTISSLQAEDVAVYYCHQYLSSPLTFGQGTKVEIK

SEQ ID NO: 28071 - DNA, 321 bp, Artificial Sequence
  Description of Artificial Sequence: Synthetic polynucleotide
gagatagtgatgacgcagtctccagccaccctgtctgtgtttccaggggaaggagccaccctctcctgcagggccagtcagagtgttagcatcaacttagcctggtaccagcagaaacctggccaggctcccagactcctcatctatggtgcatccaccagggccactggtatcccagccaggttcaatgccagtgggtctgggacagagttcactctctccatcagcagcctgcagtctgaaaattttgcagtttattactgtcagcagtataatacctggcctctcactttcggcggagggaccaaggtggaaatcaaa

SEQ ID NO: 28072 - protein, 107 aa, Artificial Sequence
  Description of Artificial Sequence: Synthetic polypeptide
EIVMTQSPATLSVFPGEGATLSCRASQSVSINLAWYQQKPGQAPRLLIYGASTRATGIPARFNASGSGTEFTLSISSLQSENFAVYYCQQYNTWPLTFGGGTKVEIK

SEQ ID NO: 28073 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagcattaccagctatttaaattggtatcagcagaaaccagggaaagcccctaagctcctgatctatactgcatccagtttgcaaagtggggtcccatcaaggttcagtggcagtggatctgggacagatttcactctcaccatcagcagtctgcaacctgaagattttgcaacttactactgtcaacagagtcacagtttcccattcactttcggccctgggaccaaagtggatatcaaa

SEQ ID NO: 28074 - protein, 107 aa, Artificial Sequence
  Description of Artificial Sequence: Synthetic polypeptide
DIQMTQSPSSLSASVGDRVTITCRASQSITSYLNWYQQKPGKAPKLLIYTASSLQSGVPSRFSGSGSGTDFTLTISSLQPEDFATYYCQQSHSFPFTFGPGTKVDIK

SEQ ID NO: 28075 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctagggatgaggctgaatattactgtcaggcgcggaacagccgcagaggggtattcggcggagggaccaggctgaccgtccta

SEQ ID NO: 28076 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQARDEAEYYCQARNSRRGVFGGGTRLTVL

SEQ ID NO: 28077 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatctatcaagatagtaagcggccctcagggatccctgagcgattctctggctccaactctggaaacacagccactctgaccatcagcgggacccaggctatggatgaggctgactattactgtcaggcgtgggacaacagaactatggtattcggcggagggaccaagctgaccgtccta

SEQ ID NO: 28078 - protein, 106 aa, Artificial Sequence
  Description of Artificial Sequence: Synthetic polypeptide
SYELTQPPSVSVSPGQTASITCSGDKLGDKYASWYQQKPGQSPVLVIYQDSKRPSGIPERFSGSNSGNTATLTISGTQAMDEADYYCQAWDNRTMVFGGGTKLTVL

SEQ ID NO: 28079 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcagctccaacatcggaagtaatattgtgacctggtaccagcagctcccaggaacggcccccaaactcctcatctatagtaatgatcagcggccctcaggggtccctgaccgattctctggctccaagtctggcacctcagcctccctggccatcagtgggctccagtctgaggatgaggctgattattactgtacagcatgggatgacagcctgaatggttgggtgttcggcggagggaccacgctgaccgtccta

SEQ ID NO: 28080 - protein, 110 aa, Artificial Sequence
  Description of Artificial Sequence: Synthetic polypeptide
QSVLTQPPSASGTPGQRVTISCSGSSSNIGSNIVTWYQQLPGTAPKLLIYSNDQRPSGVPDRFSGSKSGTSASLAISGLQSEDEADYYCTAWDDSLNGWVFGGGTTLTVL

SEQ ID NO: 28081 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagcaactccaacatcggaagtaatattgtaacctggtaccagcagctcccaggaacggcccccaaactcctcatctatagtaatgatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccacgctgaccgtccta

SEQ ID NO: 28082 - protein, 110 aa, Artificial Sequence
  Description of Artificial Sequence: Synthetic polypeptide
QSVLTQPPSASGTPGQRVTISCSGSNSNIGSNIVTWYQQLPGTAPKLLIYSNDQRPSGVPDRFSGSKSGTSASLAISGLQSEDEADYYCAAWDDSLNGWVFGGGTTLTVL

SEQ ID NO: 28083 - DNA, 330 bp, Artificial Sequence
  Description of Artificial Sequence: Synthetic polynucleotide
cagtctgtgctgactcagccaccctcagcgtctgggacccccgggcagagggtcaccatctcttgttctggaagctgctccaacatcggaagtaatattgtgacctggtaccagcagctcccaggaacggcccccaaactcctcatctatagtaatgatcagcggccctcaggggtccctgaccgattctctggctccaagtctggcacctcagcctccctggccatcagtgggctccagtctgaggatgaggctgattattactgtacagcatgggatgacagcctgaatgattgggtgttcggcggagggaccacgctgaccgtccta

SEQ ID NO: 28084 - protein, 110 aa, Artificial Sequence
  Description of Artificial Sequence: Synthetic polypeptide
QSVLTQPPSASGTPGQRVTISCSGSCSNIGSNIVTWYQQLPGTAPKLLIYSNDQRPSGVPDRFSGSKSGTSASLAISGLQSEDEADYYCTAWDDSLNDWVFGGGTTLTVL

SEQ ID NO: 28085 - DNA, 318 bp, Artificial Sequence
  Description of Artificial Sequence: Synthetic polynucleotide
tcttatgagctgactcagccaccctcagagtctgtgtccccaggacagacagccagcatcacctgctcaggagataaatcggggaataaatatgtttcctggtatcagcagaagccaggccagtcccctgtgctggtcatctatcaagataacaggcggccgtcagggatccctgagcgattttctggctccaactctgggagcacagccactttgaccatcagcgggacccaggctatggatgaggctgactattactgtcaggcgtgggacagcacccctgtgatattcggcggagggaccaagctgaccgtccta

SEQ ID NO: 28086 - protein, 106 aa, Artificial Sequence
  Description of Artificial Sequence: Synthetic polypeptide
SYELTQPPSESVSPGQTASITCSGDKSGNKYVSWYQQKPGQSPVLVIYQDNRRPSGIPERFSGSNSGSTATLTISGTQAMDEADYYCQAWDSTPVIFGGGTKLTVL

SEQ ID NO: 28087 - DNA, 318 bp, Artificial Sequence
  Description of Artificial Sequence: Synthetic polynucleotide
tcctatgagctgactcagccaccctcagtgtccgtgtccccaggacagacagccagcatcacctgctctggagataaattggggaataaatatgcttgctggtatcagcagaggccaggccagtcccctgtgctggtcatctatcaagatcgcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 28088 - protein, 106 aa, Artificial Sequence
  Description of Artificial Sequence: Synthetic polypeptide
SYELTQPPSVSVSPGQTASITCSGDKLGNKYACWYQQRPGQSPVLVIYQDRKRPSGIPERFSGSNSGNTATLTISGTQAMDEADYYCQAWDSSTVVFGGGTKLTVL

SEQ ID NO: 28089 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcaggacattagaaaggatttaggctggtatcagcagaaaccagggaaagcccctaaccgcctgatctatgctgcatccagtttgcaaagtggggtcccatcaaggttcagcggcagtggatctgggacagaattcactctcacattcagcagcctgcagcctgaagattttgcaacttattactgtctacagcatcatagttatcctcggacgttcggccaagggaccaaggtggaaatcaaa

SEQ ID NO: 28090 - protein, 107 aa, Artificial Sequence; identical to SEQ ID NO: 26376
  Description of Artificial Sequence: Synthetic polypeptide

SEQ ID NO: 28091 - DNA, 339 bp, Artificial Sequence
  Description of Artificial Sequence: Synthetic polynucleotide
gacatcgtgatgacccagtatccagactcccgggctgtgtctctgggcgagagggccaccatcaagtgcaagtccagccagagtgttttatacagctccaacaataagaactacttaacttggtaccagcagaaaccaggacagcctcccaaactgttcatttactgggcatctacccgggaatccggggttcctgaccgattcagtggcagcgggtgtgggacagatttcactctcaccatcagcagcgtgcaggccgaagatgtggcagtttattactgtcagcaatattttagtactccgtggacgttcggccaagggaccaaggtggaaatcaaa

SEQ ID NO: 28092 - protein, 113 aa, Artificial Sequence
  Description of Artificial Sequence: Synthetic polypeptide
DIVMTQYPDSRAVSLGERATIKCKSSQSVLYSSNNKNYLTWYQQKPGQPPKLFIYWASTRESGVPDRFSGSGCGTDFTLTISSVQAEDVAVYYCQQYFSTPWTFGQGTKVEIK

SEQ ID NO: 28093 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttcgcagtaacttagcctggtaccagcaggaacctggccaggctcccaggctcctcatctatggtgcatccaccagggccactggtatcccagccaggttcagtggcagtgggtctgggacagaattcactctcaccatcagcagcttgcagtctgaagattttgcagtttattactgtcagcagtcttttacctggctccggacgttcggccaagggaccaaggtggaaatcaaa

SEQ ID NO: 28094 - protein, 107 aa, Artificial Sequence
  Description of Artificial Sequence: Synthetic polypeptide
EIVMTQSPATLSVSPGERATLSCRASQSVRSNLAWYQQEPGQAPRLLIYGASTRATGIPARFSGSGSGTEFTLTISSLQSEDFAVYYCQQSFTWLRTFGQGTKVEIK

SEQ ID NO: 28095 - DNA, 321 bp, Artificial Sequence
  Description of Artificial Sequence: Synthetic polynucleotide
gacatccagatgacccagtctccatcctcactgtctgcatctgtaggagacagagtcaccatcacttgtcgggcgagtcagggcattagaaattatttagcctggtttcagcagaaaccagggaaagcccctaagtccctgatctatgctgcatccagtttgcaaagtggggtcccctcaaagttcagcggcagtggatctgggacagatttcactctcaccatcagcagcctgcagcctgaagattttgcaacttattactgccaacattatcttacttacccgctcactttcggcggagggaccaaggtggagatcaaa

SEQ ID NO: 28096 - protein, 107 aa, Artificial Sequence
  Description of Artificial Sequence: Synthetic polypeptide
DIQMTQSPSSLSASVGDRVTITCRASQGIRNYLAWFQQKPGKAPKSLIYAASSLQSGVPSKFSGSGSGTDFTLTISSLQPEDFATYYCQHYLTYPLTFGGGTKVEIK

SEQ ID NO: 28097 - DNA, 324 bp, Artificial Sequence
  Description of Artificial Sequence: Synthetic polynucleotide
gaaattgtgttgacgcagtctccaggcatcctgtctttgtatccaggggaaagagccaccctctcctgtagggccagtcagagtgttaacagcaactatttagcctggtaccagcagagacctggccaggctcccagtctcctcatttatggggcatccagcagggccacttgcatcctggacaggttcagtggcagtgggtgtgggacagacttcactctcacgatcagcagactggagcctgaagattttgcagtgtattgctgtcagcagtatgagatctcaccgtggacgttcggccaagggaccaaggtggaaagcaaa

SEQ ID NO: 28098 - protein, 108 aa, Artificial Sequence
  Description of Artificial Sequence: Synthetic polypeptide
EIVLTQSPGILSLYPGERATLSCRASQSVNSNYLAWYQQRPGQAPSLLIYGASSRATCILDRFSGSGCGTDFTLTISRLEPEDFAVYCCQQYEISPWTFGQGTKVESK

SEQ ID NO: 28099 - DNA, 339 bp, Artificial Sequence
  Description of Artificial Sequence: Synthetic polynucleotide
gacatcgtgatgacccagtctccagactccctggctgtgtctctgggcgagagggccaccatcaattgcaagtccagtcagaatattttatccagctccaacaataagaactacttaacttggtaccagcagaaaccaggacagcctcctaaaatactcatttactggacatctacccgggaatccggggtccctgaccgattcagtggcagcgggtttgggacagatttcactctcaccatcagcagcctgcaggctgaagatgtggctgtttattactgtcagcaatattttagtgttcctctgacgttcggccaagggaccaaggtggaaatcaaa

SEQ ID NO: 28100 - protein, 113 aa, Artificial Sequence
  Description of Artificial Sequence: Synthetic polypeptide
DIVMTQSPDSLAVSLGERATINCKSSQNILSSSNNKNYLTWYQQKPGQPPKILIYWTSTRESGVPDRFSGSGFGTDFTLTISSLQAEDVAVYYCQQYFSVPLTFGQGTKVEIK

SEQ ID NO: 28101 - DNA, 339 bp, Artificial Sequence
  Description of Artificial Sequence: Synthetic polynucleotide
gacatcgtgatgacccagtgtccagactccctggctgtgtctctgggcgagagggccaccatcaattgcaagtccagccagagtgttttacacagctccaacaataacaactacttagcttggtaccagcagaaaccaggacagcctcataagttgctcatttactggacatctacccgggaatccggggtccctgaccgattcagtggcagcgggtatgggacagatttctctctcaccatcgccagcctgcaggctgaagatgtggcagtttattactgtcagcaatattatagtattcctctgacgttcggccaagggaccaaggtggaaatcaaa

SEQ ID NO: 28102 - protein, 113 aa, Artificial Sequence
  Description of Artificial Sequence: Synthetic polypeptide
DIVMTQCPDSLAVSLGERATINCKSSQSVLHSSNNNNYLAWYQQKPGQPHKLLIYWTSTRESGVPDRFSGSGYGTDFSLTIASLQAEDVAVYYCQQYYSIPLTFGQGTKVEIK

SEQ ID NO: 28103 - DNA, 339 bp, Artificial Sequence
  Description of Artificial Sequence: Synthetic polynucleotide
gacatcgtgatgacccagtctccagactccctggctgtgtctctgggcgagagggccaccatcaactgcaagtccagccagagtgttttacacagctccaacaataagaactacttaacttggtaccagcagaaaccaggacagcctcataagctgctcatttactgggcatctactcgggaatccggggtccctgaccgattcagcggcagcgggtctgggacagatttcagtctcacgatcggcagcctgcagcatgaagatgtggcagtttattactgtcagcaatatcatagtattcctccgacgttcggccacgggaccaaggtggaaatcaaa

SEQ ID NO: 28104 - protein, 113 aa, Artificial Sequence
  Description of Artificial Sequence: Synthetic polypeptide
DIVMTQSPDSLAVSLGERATINCKSSQSVLHSSNNKNYLTWYQQKPGQPHKLLIYWASTRESGVPDRFSGSGSGTDFSLTIGSLQHEDVAVYYCQQYHSIPPTFGHGTKVEIK

SEQ ID NO: 28105 - DNA, 339 bp, Artificial Sequence
  Description of Artificial Sequence: Synthetic polynucleotide
gacatcgtgctgacccagtctccagactccccggctgtgtctctgggcgagagggccaccatcaattgcaagtccagccagagtgttttatccaactcccacaataacaactacttagcttggtaccagcagagaccaggacatcctcataaactcctcattttctgggcatctacccgggaatccggggtccctgaccgattcagtggcagcgggtatgggacagatttcactctcaccatcagcagcctgcaggctgaagatgtggcagtttattactgtcagcaatattatagtactccgtgcagttttggccaggggaccaagctggagatcaaa

SEQ ID NO: 28106 - protein, 113 aa, Artificial Sequence
  Description of Artificial Sequence: Synthetic polypeptide
DIVLTQSPDSPAVSLGERATINCKSSQSVLSNSHNNNYLAWYQQRPGHPHKLLIFWASTRESGVPDRFSGSGYGTDFTLTISSLQAEDVAVYYCQQYYSTPCSFGQGTKLEIK

SEQ ID NO: 28107 - DNA, 339 bp, Artificial Sequence
  Description of Artificial Sequence: Synthetic polynucleotide
gacatcgttatgacccagtgtccagactccctggctgtgtctctgggcgagagggccaccatcaattgcaagtccagccagagtgttttattcagctccaacaattataattacttagcttggtaccagcagagaccaggacagcctcataacctgctcatttactgggcatctacccgggaatccggggtccctgaccgattcagtggcagcgggtctgggacagatttcactctcaccatcagcagcctgcaggctgctgatgtggcagtttattactgtcagcaatatcatagttctcctctgacgttcggccaagggaccacggtgcaaatcaaa

SEQ ID NO: 28108 - protein, 113 aa, Artificial Sequence
  Description of Artificial Sequence: Synthetic polypeptide
DIVMTQCPDSLAVSLGERATINCKSSQSVLFSSNNYNYLAWYQQRPGQPHNLLIYWASTRESGVPDRFSGSGSGTDFTLTISSLQAADVAVYYCQQYHSSPLTFGQGTTVQIK

SEQ ID NO: 28109 - DNA, 321 bp, Artificial Sequence
  Description of Artificial Sequence: Synthetic polynucleotide
gacatccagatgacccagtctccatcctaccagtctgcatctgtgggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtttacagcataatgattacccattcactttcggccctgggaccaaagtggatatcaaa

SEQ ID NO: 28110 - protein, 107 aa, Artificial Sequence
  Description of Artificial Sequence: Synthetic polypeptide
DIQMTQSPSYQSASVGDRVTITCRASQGIRNDLGWFQQKPGKAPKRLIYAASSLQSGVPSRFSGSGSGTEFTLTISSLQPEDFATYYCLQHNDYPFTFGPGTKVDIK

SEQ ID NO: 28111 - DNA, 321 bp, Artificial Sequence
  Description of Artificial Sequence: Synthetic polynucleotide
gacatccagatgacccagtctccatcctccctgtctgcatctgtgggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatgattacccattcactttcggccctgggaccaaagtggatatcaaa

SEQ ID NO: 28112 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASSLQSGVPSRFSGSGSGTEFTLTISSLQPEDFATYYCLQHNDYPFTFGPGTKVDIK

SEQ ID NO: 28113 - DNA, 321 bp, Artificial Sequence
  Description of Artificial Sequence: Synthetic polynucleotide
gacatccagatgacccagtctccatcttccgtgtctgcatctataggagacagagtcaccatcacttgtcgggcgagtcagtttattagcagctggttagcctggtatcagcagaaaccagggaaagcccctaagctcctgatctatactgcatccagtttgcaaagtggggtcccatcaaggttcagcggcagtggatctgggacagatttcactctcaccatcagcagcctgcagcctgaagattttgcaacttactgttgtcaacaggctaacagtttcccgtggacgttcggccaagggaccaaggtggaattcaac

SEQ ID NO: 28114 - protein, 107 aa, Artificial Sequence
  Description of Artificial Sequence: Synthetic polypeptide
DIQMTQSPSSVSASIGDRVTITCRASQFISSWLAWYQQKPGKAPKLLIYTASSLQSGVPSRFSGSGSGTDFTLTISSLQPEDFATYCCQQANSFPWTFGQGTKVEFN

SEQ ID NO: 28115 - DNA, 321 bp, Artificial Sequence
  Description of Artificial Sequence: Synthetic polynucleotide
gacatccagatgacccagtctccatcctccctgtctgcatctgtgggagacagagtcaccatcacttgccgggcaagtcagggcattagaaatgatttaggctggtttcagcagaaaccagggaaagcccccaagcgcctgatctatgctgcatccagattgcaaagtggggtcccatcaaggttcagcggcagtggatctgggacagaattcactctcacaatcagcagcctgcagcctgaagattttgcaacttattactgtctacagcataatgattacccattcactttcggccctgggaccaaagtggatatcaaa

SEQ ID NO: 28116 - protein, 107 aa, Artificial Sequence
  Description of Artificial Sequence: Synthetic polypeptide
DIQMTQSPSSLSASVGDRVTITCRASQGIRNDLGWFQQKPGKAPKRLIYAASRLQSGVPSRFSGSGSGTEFTLTISSLQPEDFATYYCLQHNDYPFTFGPGTKVDIK

SEQ ID NO: 28117 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttatcactgtctacagcataatgattacccattcactttcggccctgggaccaaagtggaaatcaaa

SEQ ID NO: 28118 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYHCLQHNDYPFTFGPGTKVEIK

SEQ ID NO: 28119 - DNA, 321 bp, Artificial Sequence
  Description of Artificial Sequence: Synthetic polynucleotide
gacatccagatgacccagtctccatcttccgtgtctgcatctgtaggagacagagtcaccatcacttgtcgggcgagtcagtttattagcagctggttagcctggtatcagcagaaaccagggaaagcccctaagttcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccgtggacgttcggccaagggaccaaggtggaaatcaac

SEQ ID NO: 28120 - protein, 107 aa, Artificial Sequence
  Description of Artificial Sequence: Synthetic polypeptide
DIQMTQSPSSVSASVGDRVTITCRASQFISSWLAWYQQKPGKAPKFLIYAASSLQSGVPSRFSGSGSGTDFTLTISSLQPEDFATYYCQQANSFPWTFGQGTKVEIN

SEQ ID NO: 28121 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatcatatgttggaagtaataaatactatgcagactccgtgaagggccgattcaccatctccagagacaattccaagaacacgctgtatctgcaaatgaacaccctgagagctgaggacacggctgtgtattactgtgcgaggagaggagcagtggctccgtactacggtatggacgtctggggccaagggaccacggtcaccgtctcctca

SEQ ID NO: 28122 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAVISYVGSNKYYADSVKGRFTISRDNSKNTLYLQMNTLRAEDTAVYYCARRGAVAPYYGMDVWGQGTTVTVSS

SEQ ID NO: 28123 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgacccctaacagtggtaacacaggctatgcacagaagttccagggcagagtcaccatgaccaggaacacttccatgagcaccgcctacatggagctgagcagcctgagatctgaggactcggccgtgtattactgttcctatagcagtggctggtacatgtttgactactggggccagggaaccctggtcaccgtctcctca

SEQ ID NO: 28124 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMTPNSGNTGYAQKFQGRVTMTRNTSMSTAYMELSSLRSEDSAVYYCSYSSGWYMFDYWGQGTLVTVSS

SEQ ID NO: 28125 - DNA, 354 bp, Artificial Sequence
  Description of Artificial Sequence: Synthetic polynucleotide
caggtgcagttggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccacaagcacagcccacatggagctgagcagcctgagatctgaggacacggccgtgtattactgtgcggtctccagtggctggaactggttcgacccctggggccagggaaccctggtcaccgtctcctca

SEQ ID NO: 28126 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSTSTAHMELSSLRSEDTAVYYCAVSSGWNWFDPWGQGTLVTVSS

SEQ ID NO: 28127 - DNA, 363 bp, Artificial Sequence
  Description of Artificial Sequence: Synthetic polynucleotide
caggtgcaactggtggagtctgggggaggcgtggtccagcctgggaggtccctgagactctcctgtgcagcctctggattcaccttcagtaactatggcatgcactgggtccgccaggctccaggcaaggggctggagtgggtggcagttatatcatatgatggaagtaatgaatactatgcagactccgtgaagggccgattcaccatctccagagacaattccaagaacacgctgtatctgcaaatgaacagcctgagagctgaggacacggctgtgtattactgtgcgagagatcacagatatggggttcggggaggctttgactactggggccagggaaccctggtcaccgtctcctca

SEQ ID NO: 28128 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAVISYDGSNEYYADSVKGRFTISRDNSKNTLYLQMNSLRAEDTAVYYCARDHRYGVRGGFDYWGQGTLVTVSS

SEQ ID NO: 28129 - DNA, 354 bp, Artificial Sequence
  Description of Artificial Sequence: Synthetic polynucleotide
caggttcagctggtccagtctggagctgaggtgaagaagcctggggcctcagtgaaggtctcctgcaaggcttctggttacacctttgccacctatggtatcagctgggtgcgacaggcccctggacaggggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaggggaagcagtggctgtcttcgacccctggggccagggaaccctggtcaccgtctcctca

SEQ ID NO: 28130 - protein, 118 aa, Artificial Sequence
  Description of Artificial Sequence: Synthetic polypeptide
QVQLVQSGAEVKKPGASVKVSCKASGYTFATYGISWVRQAPGQGLEWMGWISAYNGNTNYAQKLQGRVTMTTDTSTSTAYMELRSLRSDDTAVYYCARGEAVAVFDPWGQGTLVTVSS

SEQ ID NO: 28131 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtttgatggcagtaataaatactatgtagactccgtgaaggaccgattcaccatctccagagacaattccaagaacacgctgtatctgcaaatgaacagcctgagagccgaggacacggctgtttattactgtgcgagagatcgggtggagggttcggggactccctactactactacggtatggacgtctggggccaagggaccacggtcaccgtctcctca

SEQ ID NO: 28132 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVIWFDGSNKYYVDSVKDRFTISRDNSKNTLYLQMNSLRAEDTAVYYCARDRVEGSGTPYYYYGMDVWGQGTTVTVSS

SEQ ID NO: 28133 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcactgggtgcgacaggcccctggacaagggcttgagtggatgggatggatcaaccctaacaatggtggcacaagctatgcacagaagtttcaggacagggtcaacatgaccagggacacgtccatcagcacagcctacatggagctgagcaggctgagatctgacgacacggccgtgtactactgtgcgagagatagtaggtcgtcctgggactactggggccagggaaccctggtcaccgtctcctca

SEQ ID NO: 28134 - protein, 117 aa, Artificial Sequence
  Description of Artificial Sequence: Synthetic polypeptide
QVQLVQSGAEVKKPGASVKVSCKASGYTFTGYHMHWVRQAPGQGLEWMGWINPNNGGTSYAQKFQDRVNMTRDTSISTAYMELSRLRSDDTAVYYCARDSRSSWDYWGQGTLVTVSS

SEQ ID NO: 28135 - DNA, 345 bp, Artificial Sequence
  Description of Artificial Sequence: Synthetic polynucleotide
caggtgcagctgcaggagtcgggcccaggactggtgaagccttcggagaccctgtccctcaactgcactgtctctggtggctccatcaggagttactactggagctggatccggcagcccgccgggaagggactggagtggattgggcgtatctataccagtgggagcaccgactacaacccctccctcaagagtcgaatcaccatgtcagtagacacgtccaagaaccagttctctttgaagctgagctctgtgaccgccgcggacacggccgtgtattactgtgcgagagggttcggtgactgggactactggggccagggaaccctggtcaccgtctcctca

SEQ ID NO: 28136 - protein, 115 aa, Artificial Sequence
  Description of Artificial Sequence: Synthetic polypeptide
QVQLQESGPGLVKPSETLSLNCTVSGGSIRSYYWSWIRQPAGKGLEWIGRIYTSGSTDYNPSLKSRITMSVDTSKNQFSLKLSSVTAADTAVYYCARGFGDWDYWGQGTLVTVSS

SEQ ID NO: 28137 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatttgcactgggtgcgacaggcccctggacaagggcttgagtggatgggatggatcaaccctaatagaaatggcacaaactatgcacagaagtttcagggcagggtcaccatgaccagggacacgtccatcagcacagccttcatggagctgagcaggctgagatctgacgacacggccgtgtattactgtgcgagagacggtaccagcagctttgactactggggccagggaaccctggtcaccgtctcctca

SEQ ID NO: 28138 - protein, 117 aa, Artificial Sequence
  Description of Artificial Sequence: Synthetic polypeptide
QVQLVQSGAEVKKPGASVKVSCKASGYTFTGYYLHWVRQAPGQGLEWMGWINPNRNGTNYAQKFQGRVTMTRDTSISTAFMELSRLRSDDTAVYYCARDGTSSFDYWGQGTLVTVSS

SEQ ID NO: 28139 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatttgcactgggtgcgacaggcccctggacaagggcttgagtggatgggatggatcaaccctaacagaaatggcacaaactatgcacagaattttcagggcagggtcaccatgaccagggacacgtccatcagcacagcctacatggagctgagcagactgaaatctgacgacacggccgtgtattactgtgcgagagacggtaccagtagctttgactactggggccagggaaccctggtcaccgtctcctca

SEQ ID NO: 28140 - protein, 117 aa, Artificial Sequence
  Description of Artificial Sequence: Synthetic polypeptide
QVQLVQSGAEVKKPGASVKVSCKASGYTFTGYYLHWVRQAPGQGLEWMGWINPNRNGTNYAQNFQGRVTMTRDTSISTAYMELSRLKSDDTAVYYCARDGTSSFDYWGQGTLVTVSS

SEQ ID NO: 28141 - DNA, 345 bp, Artificial Sequence
  Description of Artificial Sequence: Synthetic polynucleotide
caggtgcagctacaacagtggggcgcaggactgttgaagccttcggagaccctgtccctcacttgcgctgtcaatggtgggcccttcagcggttgctactggagctggatccgccagcccccagggaaggggctggagtggattggggaaatcaattatagtggaaggaccaacttcaacccgtccctcaagagtcgagtcaccatatcagttgacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 28142 - protein, 115 aa, Artificial Sequence
  Description of Artificial Sequence: Synthetic polypeptide
QVQLQQWGAGLLKPSETLSLTCAVNGGPFSGCYWSWIRQPPGKGLEWIGEINYSGRTNFNPSLKSRVTISVDTSKNQFSLKLSSVTAADTAVYYCARDYGGMDVWGQGTTVTVSS

SEQ ID NO: 28143 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactctctcatgcactgggtccgccaggctccaggcaaggggctggagtgggtggcagttatatggtatgatggaagtaataaatactatacagactccgttaagggccgattcaccatctccagagacaattccaagaacacgctgtatctgcaaatgaacagcctgagagccgaggacacggctgtgtattactgtgcgagagaaaactatagcagtggctggtacgggtacggtatggacgtctggggccaagggaccacggtcaccgtctcctca

SEQ ID NO: 28144 - protein, 123 aa, Artificial Sequence
  Description of Artificial Sequence: Synthetic polypeptide
QVQLVESGGGVVQPGRSLRLSCAASGFTFSDSLMHWVRQAPGKGLEWVAVIWYDGSNKYYTDSVKGRFTISRDNSKNTLYLQMNSLRAEDTAVYYCARENYSSGWYGYGMDVWGQGTTVTVSS

SEQ ID NO: 28145 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctctgtattactgtgcgagaaggtatagcagcagctggtcgggcggtatggacgtctggggccaagggaccacggtcaccgtctcctca

SEQ ID NO: 28146 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTALYYCARRYSSSWSGGMDVWGQGTTVTVSS

SEQ ID NO: 28147 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatggactgggtccgccaggctccaggcaaggggctggagtgggtggcagttatatggtatgatggaagtaatgactactatgcagactccgtgaagggccgattcaccatctccagagacaattccaagaacacgctgtttctgcaaatgaacagcctgagagccgaggacacggctgtgtattactgtgcgagagatcgggggatcgggtacaacgatatggacgtctggggccaagggaccacggtcaccgtctcctca

SEQ ID NO: 28148 - protein, 120 aa, Artificial Sequence
  Description of Artificial Sequence: Synthetic polypeptide
QVQLVESGGGVVQPGRSLRLSCAASGFTFSNYGMDWVRQAPGKGLEWVAVIWYDGSNDYYADSVKGRFTISRDNSKNTLFLQMNSLRAEDTAVYYCARDRGIGYNDMDVWGQGTTVTVSS

SEQ ID NO: 28149 - DNA, 363 bp, Artificial Sequence
  Description of Artificial Sequence: Synthetic polynucleotide
caggtgcagctggtggagtctgggggaggcgtggtccagcctgggaagtccctgagactctcctgtgctgcgtctggattcaccttcagtaactatggcttacactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcattacgatttttggagtggtcactttgactactggggccagggaaccctggtcaccgtctcctca

SEQ ID NO: 28150 - protein, 121 aa, Artificial Sequence
  Description of Artificial Sequence: Synthetic polypeptide
QVQLVESGGGVVQPGKSLRLSCAASGFTFSNYGLHWVRQAPGKGLEWVAIIWYDGSNKYYADSVKGRFTISRDNSKNTLYLQMNSLRAEDTAVYYCARDHYDFWSGHFDYWGQGTLVTVSS

SEQ ID NO: 28151 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgtaagtaataaatactatggagactccgtgaagggccgattcaccatctccagagacaattccaagaacacgctgtatctgcaaatgaacagcctgagagccgaggacacggctgtgtattactgtgcgagggaagtggggatgacttctgactactggggccagggaaccctggtcaccgtctcctca

SEQ ID NO: 28152 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDVSNKYYGDSVKGRFTISRDNSKNTLYLQMNSLRAEDTAVYYCAREVGMTSDYWGQGTLVTVSS

SEQ ID NO: 28153 - DNA, 366 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcatcagttatgatatcaactgggtgcgacaggccactggacaagggcttgagtggatgggatggatgaaccctaaaaggggtaacacaggctatgcacagaagttccagggcagagtcaccatgaccagggacacctccataagcacagcctacatggagctgagcagcctgagatctgaggacacggccgtttattactgtgcgagaggagacccgtataactggaactcctacgctatggacgtctggggccaaggggccacggtcaccgtctcctca

SEQ ID NO: 28154 - protein, 122 aa, Artificial Sequence
  Description of Artificial Sequence: Synthetic polypeptide
QVQLVQSGAEVKKPGASVKVSCKASGYTFISYDINWVRQATGQGLEWMGWMNPKRGNTGYAQKFQGRVTMTRDTSISTAYMELSSLRSEDTAVYYCARGDPYNWNSYAMDVWGQGATVTVSS

SEQ ID NO: 28155 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatgcactgggtccgccaggctccaggcaaggggctggagtgggtggcagttatatggtatgatggaagtaataaatactatgtagactccgtgaagggccgattcaccatctccagagacaattccaggaacacgctgtatctgcaaatgaacagcctgagagccgaggacacggctgtgtattactgtgcgagagaacggtatagcagtggcttgtacgactacggtatggacgtctggggccaagggaccacggtcaccgtctcctca

SEQ ID NO: 28156 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVAVIWYDGSNKYYVDSVKGRFTISRDNSRNTLYLQMNSLRAEDTAVYYCARERYSSGLYDYGMDVWGQGTTVTVSS

SEQ ID NO: 28157 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctgtggcatgcactgggtccgccaggctccaggcaaggggctggaatgggtggcagctatatggtatgatggaagcaataaatactatgcagactccgtgaagggccgattcaccatctccagagacaattccaagaacacgctgtttctgcaaatgaacagcctgagagccgaggacacggctgtgtattactgtgcgagagacaaaaatataatgggagatacttggtttgacttctggggccagggaaccctggtcaccgtctcctca

SEQ ID NO: 28158 - protein, 121 aa, Artificial Sequence
  Description of Artificial Sequence: Synthetic polypeptide
QVQLVESGGGVVQPGRSLRLSCAASGFTFSSCGMHWVRQAPGKGLEWVAAIWYDGSNKYYADSVKGRFTISRDNSKNTLFLQMNSLRAEDTAVYYCARDKNIMGDTWFDFWGQGTLVTVSS

SEQ ID NO: 28159 - DNA, 357 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctactatatgcactgggtgcgacaggcccctggacaaggacttgagtggatgggatggatcaaccctaatagtggtggcacaaactttgcacagaagtttcagggcagggtcaccttgaccagggacacgtccatcaacacagcctacatggagctgagctggctgcgatctgacgacacggccgtatattactgtgcgcgtggaaagaactatggctcctactttgactactggggccagggaaccctggtcaccgtctcctcg

SEQ ID NO: 28160 - protein, 119 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNFAQKFQGRVTLTRDTSINTAYMELSWLRSDDTAVYYCARGKNYGSYFDYWGQGTLVTVSS

SEQ ID NO: 28161 - DNA, 345 bp, Artificial Sequence; identical to SEQ ID NO: 28141
  Description of Artificial Sequence: Synthetic polynucleotide

SEQ ID NO: 28162 - protein, 115 aa, Artificial Sequence; identical to SEQ ID NO: 28142
  Description of Artificial Sequence: Synthetic polypeptide

SEQ ID NO: 28163 - DNA, 345 bp, Artificial Sequence
  Description of Artificial Sequence: Synthetic polynucleotide
caggtgcagctacaacagtggggcgcaggactgttgaagccttcggagaccctgtccctcacttgcgctgtcaatggtgggcccttcagcggttgctactggagcgggatccgccagcccccagggaaggggcgggagtggattggggaaatcaattatagtggaaggaccaacttcaacccgtccctcaagagtcgagtcaccatatcagttgacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 28164 - protein, 115 aa, Artificial Sequence
  Description of Artificial Sequence: Synthetic polypeptide
QVQLQQWGAGLLKPSETLSLTCAVNGGPFSGCYWSGIRQPPGKGREWIGEINYSGRTNFNPSLKSRVTISVDTSKNQFSLKLSSVTAADTAVYYCARDYGGMDVWGQGTTVTVSS

SEQ ID NO: 28165 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaggttataaaaactatgcagactccgtgaagggccgattcaccatctccagagacaattccaagaacacgctgtatctgcaaatgaatagcctgagagctgaggacacggctgtgtattactgtgcgagaggtacccacgggtactactacggtgtggacgtctggggccaagggaccacggtcaccgtctcctca

SEQ ID NO: 28166 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVISYDGGYKNYADSVKGRFTISRDNSKNTLYLQMNSLRAEDTAVYYCARGTHGYYYGVDVWGQGTTVTVSS

SEQ ID NO: 28167 - DNA, 345 bp, Artificial Sequence; identical to SEQ ID NO: 28141
  Description of Artificial Sequence: Synthetic polynucleotide

SEQ ID NO: 28168 - protein, 115 aa, Artificial Sequence; identical to SEQ ID NO: 28142
  Description of Artificial Sequence: Synthetic polypeptide

SEQ ID NO: 28169 - DNA, 366 bp, Artificial Sequence
  Description of Artificial Sequence: Synthetic polynucleotide
caggtgcagctgcaggagtcgggcccaggactggtgaagccttcacagaccctgtccctcacctgcattgtctctggtggctccatgaggagtggtggtgactactggagctggatccgccagcacccagggaagggcctggagtggtttgggtacatctattacagtgggagcacctactacaacccgtccctcaagagtcgagttaccttatcagtagacacgtctaagaaccagttctccctgaagctgagctctgtgactgccgcggacacggccgtgtattactgtgcgagaatggactacagtaactactactacggtatggacgtctggggccaagggacctcggtcaccgtctcctca

SEQ ID NO: 28170 - protein, 122 aa, Artificial Sequence
  Description of Artificial Sequence: Synthetic polypeptide
QVQLQESGPGLVKPSQTLSLTCIVSGGSMRSGGDYWSWIRQHPGKGLEWFGYIYYSGSTYYNPSLKSRVTLSVDTSKNQFSLKLSSVTAADTAVYYCARMDYSNYYYGMDVWGQGTSVTVSS

SEQ ID NO: 28171 - DNA, 345 bp, Artificial Sequence
  Description of Artificial Sequence: Synthetic polynucleotide
caggtgcagctccaacagtggggcgcaggactgttgaagccttcggagaccctgtccctcacttgcgctgtcaatggtgggcccttcagcggttcctactggagctggatccgccagcccccagggaaggggctggagtggattggggaaatcaattatagtggaaggaccaacttcaacccgtccctcaagagtcgagtcaccatatcagttgacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 28172 - protein, 115 aa, Artificial Sequence
  Description of Artificial Sequence: Synthetic polypeptide
QVQLQQWGAGLLKPSETLSLTCAVNGGPFSGSYWSWIRQPPGKGLEWIGEINYSGRTNFNPSLKSRVTISVDTSKNQFSLKLSSVTAADTAVYYCARDYGGMDVWGQGTTVTVSS

SEQ ID NO: 28173 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagctatatggtatgatggaagtaataaatactatgcagactccgtgaagggccgattcaccatctccagagacaattccaagaacacgctggatctgcaaatgaacagcctgagagccgaggacacggctgtgtattactgtgcgagagagttgtatagcagcaactggtacgactacggtatggacgtctggggccaagggaccacggtcaccgtctcctca

SEQ ID NO: 28174 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAAIWYDGSNKYYADSVKGRFTISRDNSKNTLDLQMNSLRAEDTAVYYCARELYSSNWYDYGMDVWGQGTTVTVSS

SEQ ID NO: 28175 - DNA, 339 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataacatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtattactgtgcgagaagcctcgacctctggggccagggaaccctggtcaccgtctcctca

SEQ ID NO: 28176 - protein, 113 aa, Artificial Sequence
  Description of Artificial Sequence: Synthetic polypeptide
EVQLVESGGGLVKPGGSLRLSCAASGFTFSSYNMNWVRQAPGKGLEWVSSISGSSSYIYYADSVKGRFTISRDNAKNSLYLQMNSLRAEDTAVYYCARSLDLWGQGTLVTVSS

SEQ ID NO: 28177 - DNA, 345 bp, Artificial Sequence
  Description of Artificial Sequence: Synthetic polynucleotide
gaggtgcagttggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagcagttacatatactacgtagactcagtgaagggccgattcaccatctccagagacaacgccaagaactcactgtatctgcaaatgaacagcctgagagccgaggacacggctgtgtattactgtgcgagagtcaactcttttgactcctggggccagggaaccctggtcaccgtctcctca

SEQ ID NO: 28178 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYVDSVKGRFTISRDNAKNSLYLQMNSLRAEDTAVYYCARVNSFDSWGQGTLVTVSS

SEQ ID NO: 28179 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttcttagtggtagtggtggtagcacattctacgcagactccgtgaagggccggttcaccatctccagagagaattccaagaacacgctgtatctgcaaatgagcagcctgagagccgaggacacggccgtatattactgtgcccgaagaggccgtgaatatagtggctacgattactttgactactggggccagggaaccctggtcaccgtctcctca

SEQ ID NO: 28180 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSVLSGSGGSTFYADSVKGRFTISRENSKNTLYLQMSSLRAEDTAVYYCARRGREYSGYDYFDYWGQGTLVTVSS

SEQ ID NO: 28181 - DNA, 354 bp, Artificial Sequence
  Description of Artificial Sequence: Synthetic polynucleotide
caggtgcagctggtgcaatctggggctgaggtgaagaagcctggggcctcagtgaaggtctcctgcaaggcttctggatacaccttcaccaattatgatgtcaactgggtgcgacaggccactggacaagggcttgagtggatgggatggatgcaccctaacagtggtaacacaggctatgcacagaagttccggggcagagtcaccatgaccaggaacacctccctaagcacagtctacatggagctgagcagcctgcgatctgaggacacggccgtgtattactgtgcctatagcagtggctggtacgtttttgactactggggccagggaaccctggtcaccgtctcctca

SEQ ID NO: 28182 - protein, 118 aa, Artificial Sequence
  Description of Artificial Sequence: Synthetic polypeptide
QVQLVQSGAEVKKPGASVKVSCKASGYTFTNYDVNWVRQATGQGLEWMGWMHPNSGNTGYAQKFRGRVTMTRNTSLSTVYMELSSLRSEDTAVYYCAYSSGWYVFDYWGQGTLVTVSS

SEQ ID NO: 28183 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatgtcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgcgatctgaggacacggccgtgtattactgtgcctatagcagtggctggtacgtttttgactcctggggccagggaaccctggtcaccgtctcctca

SEQ ID NO: 28184 - protein, 118 aa, Artificial Sequence
  Description of Artificial Sequence: Synthetic polypeptide
QVQLVQSGAEVKKPGASVKVSCKASGYTFTNYDVNWVRQATGQGLEWMGWMHPNSGNTGYAQKFQGRVTMTRNTSISTAYMELSSLRSEDTAVYYCAYSSGWYVFDSWGQGTLVTVSS

SEQ ID NO: 28185 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggtcactggacaagggcttgagtggatgggatggatgcaccctaacagtggtaacacaggctatgcacagaagttccagggcagagtcaccatgaccaggaacacctccataagcacagcctacatggaactgaacagcctgagatctgaggacacggccgtgtattactgttcgcatagcagtggctggtacctctttgactactggggccagggaaccctggtcaccgtctcctca

SEQ ID NO: 28186 - protein, 118 aa, Artificial Sequence
  Description of Artificial Sequence: Synthetic polypeptide
QVQLVQSGAEVKKPGASVKVSCKASGYTFTNYDINWVRQVTGQGLEWMGWMHPNSGNTGYAQKFQGRVTMTRNTSISTAYMELNSLRSEDTAVYYCSHSSGWYLFDYWGQGTLVTVSS

SEQ ID NO: 28187 - DNA, 357 bp, Artificial Sequence
  Description of Artificial Sequence: Synthetic polynucleotide
cagctgcagctgcaggagtcgggcccaggactggtgacgccttcggagaccctgtccctcacctgcactgtctctggcggctccatcagcaggagtagttactactggggctggatccgccagcccccagggaaggggctggagtggattgggagtatctattatagtgggagcgcctactccaacccgtccctcaagagtcgagtcaccatatccgtagacacgtccaagaaccagttctccctgaagctgagctctgtgaccgccgcggacacggctctgttttactgtgcgagacttgactctaactggggtcttgactactggggccagggaaccctggtcaccgtctcctca

SEQ ID NO: 28188 - protein, 119 aa, Artificial Sequence
  Description of Artificial Sequence: Synthetic polypeptide
QLQLQESGPGLVTPSETLSLTCTVSGGSISRSSYYWGWIRQPPGKGLEWIGSIYYSGSAYSNPSLKSRVTISVDTSKNQFSLKLSSVTAADTALFYCARLDSNWGLDYWGQGTLVTVSS

SEQ ID NO: 28189 - DNA, 369 bp, Artificial Sequence
  Description of Artificial Sequence: Synthetic polynucleotide
caggtgcagctggtggagtctgggggaggcgtggcccagcctgggaggtccctgagactctcctgtgcagcgtctggattcaccttcagtgactatggcatgcactgggtccgccaggctccaggcaaggggctggagtgggtggcagttatatggtatgatggaagtaataagtactatgcagactccgtgaagggccgactcaccatctccagagacaattccaagaacacgctgtatctgcaaatgaacagcctgagagccgaggacacggctgtgtattactgtgcgagagagaggtatagcagtggctggtacgactacggtttggacgtctggggccaagggaccacggtcaccgtctcctca

SEQ ID NO: 28190 - protein, 123 aa, Artificial Sequence
  Description of Artificial Sequence: Synthetic polypeptide
QVQLVESGGGVAQPGRSLRLSCAASGFTFSDYGMHWVRQAPGKGLEWVAVIWYDGSNKYYADSVKGRLTISRDNSKNTLYLQMNSLRAEDTAVYYCARERYSSGWYDYGLDVWGQGTTVTVSS

SEQ ID NO: 28191 - DNA, 369 bp, Artificial Sequence
  Description of Artificial Sequence: Synthetic polynucleotide
caggtgcagctggtggagtctgggggaggcgtggtccagcctgggaggtccctgagcctctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaacagtatagcagcagctggtacgacttcggtctggacgtctggggccaagggaccacggtcaccgtctcctca

SEQ ID NO: 28192 - protein, 123 aa, Artificial Sequence
  Description of Artificial Sequence: Synthetic polypeptide
QVQLVESGGGVVQPGRSLSLSCAASGFTFSSYVMHWVRQAPGKGLEWVAVIWYDGSNKYYADSVKGRFTISRDNSKNTLYLQMNSLRAEDTAVYYCAREQYSSSWYDFGLDVWGQGTTVTVSS

SEQ ID NO: 28193 - DNA, 372 bp, Artificial Sequence
  Description of Artificial Sequence: Synthetic polynucleotide
caggtgcagctggtgcagtctggggctgaggtgaggacgcctggggcctcagtgaaggtctcctgcaaggcttctggatacaccttcaccgactattatatgcactgggtgcgacaggcccctggacaagggcttgagtggatgggatggatcaaccctaacagaggtggcacaaactatgctcagaagtttcagggcagggtcaccatgaccagggacacgtccatcagcacagcctacatggagctgagcaggctgagatctgacgacacggccgtgtattactgtgcgagagaggaggatcgcagtggctggtactactactacggtatggacgtctggggccaagggaccacggtcaccgtctcctca

SEQ ID NO: 28194 - protein, 124 aa, Artificial Sequence
  Description of Artificial Sequence: Synthetic polypeptide
QVQLVQSGAEVRTPGASVKVSCKASGYTFTDYYMHWVRQAPGQGLEWMGWINPNRGGTNYAQKFQGRVTMTRDTSISTAYMELSRLRSDDTAVYYCAREEDRSGWYYYYGMDVWGQGTTVTVSS

SEQ ID NO: 28195 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaaagatgatgagcgctacagcccatctctgaagagcaggctcaccatcaccaaggacacttccaaaaaccaggtggtccttacaatgaccaacatggaccctgtggacacagccacatattactgtgcacatgcagtggctgtctcctttgactactggggccagggaaccctggtcaccgtctcctca

SEQ ID NO: 28196 - protein, 118 aa, Artificial Sequence
  Description of Artificial Sequence: Synthetic polypeptide
QITLKESGPTLVKPTQTLTLTCTFSGFSLSTSGVGVGWIRQPPGKALEWLALIYWKDDERYSPSLKSRLTITKDTSKNQVVLTMTNMDPVDTATYYCAHAVAVSFDYWGQGTLVTVSS

SEQ ID NO: 28197 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaaggacttgagtggatgggatggatcaacccttacagtggtggcacaaactatgcacagaagtttcagggcagggtcaccatgaccagggacacgtccatcagcacagcctacatggaactgagcaggctgagatctgacgacacggccgtgtattactgtgcgagagatagagcagtggctggaaactacttctactacggtatggacgtctggggccaagggaccacggtcaccgtctcctca

SEQ ID NO: 28198 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPYSGGTNYAQKFQGRVTMTRDTSISTAYMELSRLRSDDTAVYYCARDRAVAGNYFYYGMDVWGQGTTVTVSS

SEQ ID NO: 28199 - DNA, 357 bp, Artificial Sequence
  Description of Artificial Sequence: Synthetic polynucleotide
caactgcagctgcaggagtcgggcccgggactggtgaagccttcggagaccctgtccctcacctgcactgtctctggtggctccatcagcggtagtagttactactggggctggatccgccagcccccggggaaggggctggagtggattgggaatatctattatagtgggagcacctaccacaacccgtccctcaagagtcgagtcaccatatccgtggacacgtccaagaaccagttctccctgaagctgacctctgtgaccgccgcagacacggctgtgttttactgtgcgagacatgatttactttggtcccttgacttctggggccagggaattctggtcaccgtctcctca

SEQ ID NO: 28200 - protein, 119 aa, Artificial Sequence
  Description of Artificial Sequence: Synthetic polypeptide
QLQLQESGPGLVKPSETLSLTCTVSGGSISGSSYYWGWIRQPPGKGLEWIGNIYYSGSTYHNPSLKSRVTISVDTSKNQFSLKLTSVTAADTAVFYCARHDLLWSLDFWGQGILVTVSS

SEQ ID NO: 28201 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggcctctggacaaggacttgagtggatgggatggatgcaccctaacagtggtaacacaggctatgcacagaagttccagggcagagtcaccatgaccaggaacacctccataagcacagcctacatggagctgagcagcctgagatctgaggactcggccgtatattactgtgcgtatagtagtggctggtacaaatttgactactggagccagggaaccctggtcaccgtctcctca

SEQ ID NO: 28202 - protein, 118 aa, Artificial Sequence
  Description of Artificial Sequence: Synthetic polypeptide
QVQLVQSGAEVKKPGASVKVSCKASGYTFTNYDINWVRQASGQGLEWMGWMHPNSGNTGYAQKFQGRVTMTRNTSISTAYMELSSLRSEDSAVYYCAYSSGWYKFDYWSQGTLVTVSS

SEQ ID NO: 28203 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataccatgaactgggtccgccaggctccagggaaggggctggagtgggtctcatccataagtggtagtagtagttacttatactacccagactcagtgaagggccgattcaccatctccagagacaacgccaagaactctctgtatctgcaaatgaacagcctgagagccgaggacacggctgtgtattactgtgcgagagatagaggcagcagctggggccagggaaccctggtcaccgtctcctca

SEQ ID NO: 28204 - protein, 114 aa, Artificial Sequence
  Description of Artificial Sequence: Synthetic polypeptide
EVQLVESGGGLVKPGGSLRLSCAASGFTFSSYTMNWVRQAPGKGLEWVSSISGSSSYLYYPDSVKGRFTISRDNAKNSLYLQMNSLRAEDTAVYYCARDRGSSWGQGTLVTVSS

SEQ ID NO: 28205 - DNA, 342 bp, Artificial Sequence; identical to SEQ ID NO: 28203
  Description of Artificial Sequence: Synthetic polynucleotide

SEQ ID NO: 28206 - protein, 114 aa, Artificial Sequence; identical to SEQ ID NO: 28204
  Description of Artificial Sequence: Synthetic polypeptide

SEQ ID NO: 28207 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcggttatatggtatgatggaagtaataaatactatgcagactccgtgaaggtccgattcaccgtctccagagacaattccaagaacacgctgtctctgcaaatgaacagcctgagagccgaggacacggctgtgtattactgtgcgagagagagatataccagtggctggtatgactacggtatggacgtctggggccaagggaccacggtcaccgtctcctca

SEQ ID NO: 28208 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKVRFTVSRDNSKNTLSLQMNSLRAEDTAVYYCARERYTSGWYDYGMDVWGQGTTVTVSS

SEQ ID NO: 28209 - DNA, 369 bp, Artificial Sequence; identical to SEQ ID NO: 28207
  Description of Artificial Sequence: Synthetic polynucleotide

SEQ ID NO: 28210 - protein, 123 aa, Artificial Sequence; identical to SEQ ID NO: 28208
  Description of Artificial Sequence: Synthetic polypeptide

SEQ ID NO: 28211 - DNA, 351 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaacgactactatttgcactgggtgcgacaggcccctggacaaggtcttgagtggatgggatggatccaccctaacagtggtggcacaaactatgcacagaagtttcagggcagggtcaccatgaccagggacacgtccatcagcacagcctacatggagctgagcagcctgagatctgacgacacggccgtgtattcctgtgcgagagatggtaccagctcgtttgactactggggccagggaaccctggtcaccgtctcctca

SEQ ID NO: 28212 - protein, 117 aa, Artificial Sequence
  Description of Artificial Sequence: Synthetic polypeptide
QVQLVQSGAEVKKPGASVKVSCKASGYTFNDYYLHWVRQAPGQGLEWMGWIHPNSGGTNYAQKFQGRVTMTRDTSISTAYMELSSLRSDDTAVYSCARDGTSSFDYWGQGTLVTVSS

SEQ ID NO: 28213 - DNA, 351 bp, Artificial Sequence; identical to SEQ ID NO: 28211
  Description of Artificial Sequence: Synthetic polynucleotide

SEQ ID NO: 28214 - protein, 117 aa, Artificial Sequence; identical to SEQ ID NO: 28212
  Description of Artificial Sequence: Synthetic polypeptide

SEQ ID NO: 28215 - DNA, 351 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcgccgactactatttgcactgggtgcgacaggcccctggacaaggtcttgagtggatgggatggatccaccctaacagtggtggcacaaactttgcacagaagtttcagggcagggtcaccatgaccagggacacgtccatcagcacagcctacctggaactgagcagtctgagatctgacgacacggccttctattactgtgcgagagatggtaccagctcgtttgactactggggccagggaaccctggtcaccgtctcctca

SEQ ID NO: 28216 - protein, 117 aa, Artificial Sequence
  Description of Artificial Sequence: Synthetic polypeptide
QVQLVQSGAEVKKPGASVKVSCKASGYTFADYYLHWVRQAPGQGLEWMGWIHPNSGGTNFAQKFQGRVTMTRDTSISTAYLELSSLRSDDTAFYYCARDGTSSFDYWGQGTLVTVSS

SEQ ID NO: 28217 - DNA, 351 bp, Artificial Sequence; identical to SEQ ID NO: 28215
  Description of Artificial Sequence: Synthetic polynucleotide

SEQ ID NO: 28218 - protein, 117 aa, Artificial Sequence; identical to SEQ ID NO: 28216
  Description of Artificial Sequence: Synthetic polypeptide

SEQ ID NO: 28219 - DNA, 372 bp, Artificial Sequence
  Description of Artificial Sequence: Synthetic polynucleotide
caggtgaaactggtgcagtctggggctgaggtggagaagcctggggcctcagtgaaggtctcctgcaaggcttcaggatacaccttcaccggctactatctgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagtgtattactatggttcggggagttattataacgagtttgacaactggggccagggaaccctggtcaccgtctcctca

SEQ ID NO: 28220 - protein, 124 aa, Artificial Sequence
  Description of Artificial Sequence: Synthetic polypeptide
QVKLVQSGAEVEKPGASVKVSCKASGYTFTGYYLHWVRQAPGQGLEWMGWINPNSGGTNYAQKFQGRVTMTRDTSISTAYMELSRLRSDDTAVYYCARVYYYGSGSYYNEFDNWGQGTLVTVSS

SEQ ID NO: 28221 - DNA, 372 bp, Artificial Sequence; identical to SEQ ID NO: 28219
  Description of Artificial Sequence: Synthetic polynucleotide

SEQ ID NO: 28222 - protein, 124 aa, Artificial Sequence; identical to SEQ ID NO: 28220
  Description of Artificial Sequence: Synthetic polypeptide

SEQ ID NO: 28223 - DNA, 372 bp, Artificial Sequence
  Description of Artificial Sequence: Synthetic polynucleotide
  modified_base (60)..(60): a, c, t, g, unknown or other
caggtgcagttggtgcagtttgggggtgaggtgaagaagcctgggtcctcagtgaaggtntcctgcaaggcttcaggatacaccttcaccggytactatatgcactgggtgcgacaggcccctggacaagggcttgagtggatgggatcgatctaccgtaacagtggtggcacaaattatgcacagaagtttcagggcagggtcaccatgaccagggacaagtccatcagcaccgcctacatggagaagagcaggatcagatctgatgacacggccgtgtattactgtgcgagagccttttactatggttcggggacttattataacgaatttgactactggggccagggaaccctggtcaccgtctcctca

SEQ ID NO: 28224 - protein, 124 aa, Artificial Sequence
  Description of Artificial Sequence: Synthetic polypeptide
QVQLVQFGGEVKKPGSSVKVSCKASGYTFTGYYMHWVRQAPGQGLEWMGSIYRNSGGTNYAQKFQGRVTMTRDKSISTAYMEKSRIRSDDTAVYYCARAFYYGSGTYYNEFDYWGQGTLVTVSS

SEQ ID NO: 28225 - DNA, 360 bp, Artificial Sequence
  Description of Artificial Sequence: Synthetic polynucleotide
cagatcaccttgaaggagtctggtcctacgctggtgaaacccacacagaccctcacgctgacctgcaccttctctggattctcactcagcactagtggagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcagacaccggtgtcagctgctgctattttcactattggggccagggaaccctggtcaccgtctcctca

SEQ ID NO: 28226 - protein, 120 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCADTGVSCCYFHYWGQGTLVTVSS

SEQ ID NO: 28227 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactggtggagtgggtgtgggctggatccgtcagcccccaggaaaggccctggagtggcttgtattcatttattggagtgatgataagcgctacagcccatctctgaagagcaggctctccatcaccaaggacacctccaaaaaccaggtggtccttacaatgaccaacatggaccctgtggacacagccacatattactgtgcacgtatagcagcagttgcctttgactactggggccagggaaccctggtcaccgtctcctca

SEQ ID NO: 28228 - protein, 118 aa, Artificial Sequence
  Description of Artificial Sequence: Synthetic polypeptide
QITLKESGPTLVKPTQTLTLTCTFSGFSLSTGGVGVGWIRQPPGKALEWLVFIYWSDDKRYSPSLKSRLSITKDTSKNQVVLTMTNMDPVDTATYYCARIAAVAFDYWGQGTLVTVSS

SEQ ID NO: 28229 - DNA, 384 bp, Artificial Sequence
  Description of Artificial Sequence: Synthetic polynucleotide
caggtgcagctggtgcagtctggggctgaggtgaagaagcctggggcctcagtgaaggtctcctgccagggttctggatacaccttcaccggccactatatgtgctgggtgcgacaggcccctggacaagggcttgagtggatgggatggatcaaccctaatagtggtggcacaaactatgcacagaagtttcagggcagggtcaccatgaccagggacacgtccatcagcacagcctacatggagctgagcaggctgagatctgacgacacggccgtgtattactgtgcggctggatattgtagtagttccagctgctatttgcaaccgggttattacggtatggacgtctggggccaagggaccacggtcaccgtctcctca

SEQ ID NO: 28230 - protein, 128 aa, Artificial Sequence
  Description of Artificial Sequence: Synthetic polypeptide
QVQLVQSGAEVKKPGASVKVSCQGSGYTFTGHYMCWVRQAPGQGLEWMGWINPNSGGTNYAQKFQGRVTMTRDTSISTAYMELSRLRSDDTAVYYCAAGYCSSSSCYLQPGYYGMDVWGQGTTVTVSS

SEQ ID NO: 28231 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtgcctttcactcatttattggaatgatgataaggtctacagcccatctctgaagagcaggctcaccatcaccaagtacacctccaaaaaccaggtggtccttacaatgaccaacatggaccctgtggacacagccacatattactgtgcacacaggggacagcagctggccctcgactactggggccagggaaccctggtcaccgtctcctca

SEQ ID NO: 28232 - protein, 119 aa, Artificial Sequence
  Description of Artificial Sequence: Synthetic polypeptide
QITLKESGPTLVKPTQTLTLTCTFSGFSLSTSGVGVGWIRQPPGKALECLSLIYWNDDKVYSPSLKSRLTITKYTSKNQVVLTMTNMDPVDTATYYCAHRGQQLALDYWGQGTLVTVSS

SEQ ID NO: 28233 - DNA, 390 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtggctatggcatgcactgggtccgccaggctccaggcaaggggctggagtgggtggcagttatatggtatgatggaagtaataaatactatgcagactccgtgaagggccgattcaccatctccagagacaattccaagaacacgctgtttctgcaaatgaacagcctgagagccgaggacacggctgtgtattactgtgcgagagatagggtatattgtagtagtaccagctgctccccttactactactactacggtatggacgtctggggccaagggaccacggtcaccgtctcctca

SEQ ID NO: 28234 - protein, 130 aa, Artificial Sequence
  Description of Artificial Sequence: Synthetic polypeptide
QVQLVESGGGVVQPGRSLRLSCAASGFTFSGYGMHWVRQAPGKGLEWVAVIWYDGSNKYYADSVKGRFTISRDNSKNTLFLQMNSLRAEDTAVYYCARDRVYCSSTSCSPYYYYYGMDVWGQGTTVTVSS

SEQ ID NO: 28235 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcaatactggtggagtgggtgtgggctggatccgtcagcccccaggaaaggccctggagtggcttgcactcatttattggaatgatgataagcgccacagcccatctctgaagagcaggctcaccatcaccaaagacacctccaaaaaccaggtggtccttacaatgacccacatggcccctgtggacacagccacatattactgtgcacaccttatagaagtggcctttgactattggggccagggaaccctggtcaccgtctcctca

SEQ ID NO: 28236 - protein, 118 aa, Artificial Sequence
  Description of Artificial Sequence: Synthetic polypeptide
QITLKESGPTLVKPTQTLTLTCTFSGFSLNTGGVGVGWIRQPPGKALEWLALIYWNDDKRHSPSLKSRLTITKDTSKNQVVLTMTHMAPVDTATYYCAHLIEVAFDYWGQGTLVTVSS

SEQ ID NO: 28237 - DNA, 372 bp, Artificial Sequence
  Description of Artificial Sequence: Synthetic polynucleotide
gaggtgcagttgttggaatctgggggaggcttggtacagcctggggggtccctgagactctcctgtgcagcctctggattcacctttagcagctatgtcatgagctgggtccgccaggctccagggaaggggctggagtgggtctcaactattagtgttggtggtggtagcacatactacgcagactccgtgaagggccggttcaccatctccagagacaattccaagaccacgctgtatctgcaaatgaacagcctgagagccgaggacacggccgtatattactgtgcgaaatggggacgtggatacagctatgaatactactacggtatggacgtctggggccaagggaccacggtcaccgtctcctca

SEQ ID NO: 28238 - protein, 124 aa, Artificial Sequence
  Description of Artificial Sequence: Synthetic polypeptide
EVQLLESGGGLVQPGGSLRLSCAASGFTFSSYVMSWVRQAPGKGLEWVSTISVGGGSTYYADSVKGRFTISRDNSKTTLYLQMNSLRAEDTAVYYCAKWGRGYSYEYYYGMDVWGQGTTVTVSS

SEQ ID NO: 28239 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatggggtggatcaaccctaacagtggtggcacaaactatgcacagaagtttcagggcagggtcaccatgaccagggactcgtccatcaacacagcctacatggagctgagcaggctgagatctgacgacacggccgtgtattactgtgcgaggtcgtactactatggttcggggagttattataacgagtttgactactggggccagggaaccctggtcaccgtctcctca

SEQ ID NO: 28240 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDSSINTAYMELSRLRSDDTAVYYCARSYYYGSGSYYNEFDYWGQGTLVTVSS

SEQ ID NO: 28241 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagtcatatggtatgatggaaataataaatactatgtagactccgtgaagggccgattcaccatctccagagacaattccaagaatacgctgtatctgcaaatgaacagcctgagagccgaggacacggctgtgtattactgtgcgagagagcttgcctggtacgaggactactggggccagggaaccctggtcaccgtctcctca

SEQ ID NO: 28242 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDGNNKYYVDSVKGRFTISRDNSKNTLYLQMNSLRAEDTAVYYCARELAWYEDYWGQGTLVTVSS

SEQ ID NO: 28243 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtacttacatatactacgcagactcagtgaagggccgattcaccatctccagagacaacgccaagaactcactgtatctgcaaatgaacagcctgagagccgaggacacggctgtgtattactgtgcgagagtggcttcatttgactactggggccagggaaccctggtcaccgtctcctca

SEQ ID NO: 28244 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISSSSTYIYYADSVKGRFTISRDNAKNSLYLQMNSLRAEDTAVYYCARVASFDYWGQGTLVTVSS

SEQ ID NO: 28245 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtagaagtagttactactggggctggatccgccagcccccagggagggggctggagtggattgggaatatctattatggtgggaacacctactacaacccgtccctcaagagtcgagtcaccatatccgtagacacgtccaagaaccagttctccctgaagctgagctctgtgaccgccgcagacacggctgtgtattactgtgcgagacatggaaaagactggggccttgactactggggccagggaaccctggtcaccgtctcctca

SEQ ID NO: 28246 - protein, 119 aa, Artificial Sequence
  Description of Artificial Sequence: Synthetic polypeptide
QLQLQESGPGLVKPSETLSLTCTVSGGSISRSSYYWGWIRQPPGRGLEWIGNIYYGGNTYYNPSLKSRVTISVDTSKNQFSLKLSSVTAADTAVYYCARHGKDWGLDYWGQGTLVTVSS

SEQ ID NO: 28247 - DNA, 342 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtagctataccatgaactgggtccgccaggctccagggaaggggctggagtgggtctcatccattagtggtagtagtagttacatatactacgcagactcagtgaagggccgattcaccatctccagagacaacgccaagaactcactgtatttgcaaatgaacagcctgagagccgaggacacggctgtatattactgtgcgagagatcgaggctccatctggggccaagggacaatggtcaccgtctcttca

SEQ ID NO: 28248 - protein, 114 aa, Artificial Sequence
  Description of Artificial Sequence: Synthetic polypeptide
EVQLVESGGGLVKPGGSLRLSCAASGFTFSSYTMNWVRQAPGKGLEWVSSISGSSSYIYYADSVKGRFTISRDNAKNSLYLQMNSLRAEDTAVYYCARDRGSIWGQGTMVTVSS

SEQ ID NO: 28249 - DNA, 351 bp, Artificial Sequence
  Description of Artificial Sequence: Synthetic polynucleotide
caggtgcagttggtggagtctgggggaggcgtggtccagcctgggaggtccctgagactctcctatacagcgtctggattcaccttcagtgactatggcatgcactgggtccgccaggctccaggcaaggggctggagtgggtggcagttatatggtttgatggaagtaataaatactatgcagactccgtgaagggccgattcaccatctccagagacaattccaagaacacgctgtatctgcaaatgaacagcctgagagccgaggacacggctgtgtattactgtgcgagagatcttggctggacggaagagtactggggccagggaaccctggtcaccgtctcctca

SEQ ID NO: 28250 - protein, 117 aa, Artificial Sequence
  Description of Artificial Sequence: Synthetic polypeptide
QVQLVESGGGVVQPGRSLRLSYTASGFTFSDYGMHWVRQAPGKGLEWVAVIWFDGSNKYYADSVKGRFTISRDNSKNTLYLQMNSLRAEDTAVYYCARDLGWTEEYWGQGTLVTVSS

SEQ ID NO: 28251 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaaggggctggagtggattgggaatatctattatagtgggactgcctactgtaattcgtccctcaagagtcgagtcattatatccgtagacacgtccaagaaccagttctccctgaagctgagctctgtgaccgccacagacacggctgtgtattactgtgcgagacatagtagcagctggtcccttgacaactggggccagggaaccctggtcaccgtctcctca

SEQ ID NO: 28252 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGTAYCNSSLKSRVIISVDTSKNQFSLKLSSVTATDTAVYYCARHSSSWSLDNWGQGTLVTVSS

SEQ ID NO: 28253 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctgtgtattactgtgcgagagaactggggttccggtctgactactggggccagggaaccctggtcaccgtctcctca

SEQ ID NO: 28254 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYEENNQYYADSVKGRFTISRDNSKNTLYLQMNSLRAEDTAVYYCARELGFRSDYWGQGTLVTVSS

SEQ ID NO: 28255 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagtctcatatactacgcagactcagtgaagggccgattcaccatctccagagacaacgccaagaactcactgtatctgcaaatgaacagcctgagagccgaggacacggctgtgtattactgtgcgagagtagcagcctttgactactggggccagggaaccctggtcaccgtctcctca

SEQ ID NO: 28256 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSLIYYADSVKGRFTISRDNAKNSLYLQMNSLRAEDTAVYYCARVAAFDYWGQGTLVTVSS

SEQ ID NO: 28257 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactgtgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaaagtatagcagcagctggtacgactacggtatggacgtctggggccaagggaccacggtcaccgtctcctca

SEQ ID NO: 28258 - protein, 123 aa, Artificial Sequence
  Description of Artificial Sequence: Synthetic polypeptide
QVQLVESGGGVVQPGRSLRLSCAASGFTFSNCVMHWVRQAPGKGLEWVAVIWYDGSNKYYADSVKGRFTISRDNSKNTLYLQMNSLRAEDTAVYYCAREKYSSSWYDYGMDVWGQGTTVTVSS

SEQ ID NO: 28259 - DNA, 384 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctcgcaacactgctgcttggagctggatcaggcagtccccatcgagaggccttgagtggctgggaaggacatactacaggtccaagtggtataatgattatgcagtatctgtgaaaagtcgagtaaccatcaacccagacacatccaagaaccagttctccctgcagctgaactctgtgactcccgaggacacggctgtgtattactgtgcaagagtaagcagtggctggtcccatcactactactactacggtatggacgtctggggccaagggaccacggtcaccgtctcctca

SEQ ID NO: 28260 - protein, 128 aa, Artificial Sequence
  Description of Artificial Sequence: Synthetic polypeptide
QVQLQQSGPGLVKPSQTLSLTCAISGDSVSRNTAAWSWIRQSPSRGLEWLGRTYYRSKWYNDYAVSVKSRVTINPDTSKNQFSLQLNSVTPEDTAVYYCARVSSGWSHHYYYYGMDVWGQGTTVTVSS

SEQ ID NO: 28261 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggcggctccatcagcagaagtagttactattggggctggatccgccagcccccagggaagggcctggagtggattgggaatatctattatagtgggagcacctactacaatccgtccctcaagagtcgagtcaccatatccgtagactcgtccaagaaccagttctccctgaacctgaactctgtgaccgccgcagacacggctgtgtattcctgtgcgagacatggaaaagactggggccttgactactggggccagggaaccctggtcaccgtctcctca

SEQ ID NO: 28262 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYYNPSLKSRVTISVDSSKNQFSLNLNSVTAADTAVYSCARHGKDWGLDYWGQGTLVTVSS

SEQ ID NO: 28263 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagtgtctggattcaccttcagtagctatggcatgcattgggtccgccaggctccaggcaaggggctggagtgggtggcagttatatggtatgaggaaaataataaatattatgtagactccgtgaagggccgattcaccatctccagagacaattccaagagcacgctgtatctgcaaatgaacagcctgagagccgaggacacggctgtgtattactgtgtgagagagctaggcttccagtctgactactggggccagggaaccccggtcaccgtctcctca

SEQ ID NO: 28264 - protein, 117 aa, Artificial Sequence
  Description of Artificial Sequence: Synthetic polypeptide
QVQLVESGGGVVQPGRSLRLSCAVSGFTFSSYGMHWVRQAPGKGLEWVAVIWYEENNKYYVDSVKGRFTISRDNSKSTLYLQMNSLRAEDTAVYYCVRELGFQSDYWGQGTPVTVSS

SEQ ID NO: 28265 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttattactggggctggatccgccagcccccagggaaggggctggagtggattgggaatatctattatagtgggtacacctactacaacccgtccctcaagagtcgagtcatcatatccgtagacacgtccaagaaccagttctccctgaagctgagctctgtgaccgccgcagacacggctctgtattactgtgcgagacatagtagcagttggtcccttgacgactggggccagggaaccctggtcaccgtctcctct

SEQ ID NO: 28266 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGYTYYNPSLKSRVIISVDTSKNQFSLKLSSVTAADTALYYCARHSSSWSLDDWGQGTLVTVSS

SEQ ID NO: 28267 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctcccggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctgtgtattactgtgcgagagaactggggttccggtctgactactggggccagggaaccctggtcaccgtctcctca

SEQ ID NO: 28268 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEENNQYYADSVKGRFTISRDNSKNTLYLQMNSLRAEDTAVYYCARELGFRSDYWGQGTLVTVSS

SEQ ID NO: 28269 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagcgatgacatgcactgggtccgccaggaaccaggcaaggggctggagtgggtggcagttatatggtttgatggaagtaataaatactatgcagactccgtgaagggccgattcatcatgtccagagacaattccaagaacaccctgtatctgcaaatgaacagcctgagagccggggacacggctgtgtattactgtgcgagagatctgatagcagcagctggtacggttgactactggggccagggaaccctggtcaccgtctcctca

SEQ ID NO: 28270 - protein, 120 aa, Artificial Sequence
  Description of Artificial Sequence: Synthetic polypeptide
QVQLVESGGGVVQPGRSLRLSCAASGFTLSSDDMHWVRQEPGKGLEWVAVIWFDGSNKYYADSVKGRFIMSRDNSKNTLYLQMNSLRAGDTAVYYCARDLIAAAGTVDYWGQGTLVTVSS

SEQ ID NO: 28271 - DNA, 384 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctcgcaacactgctgcttggagctggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagtaaacagtggctggtcccatcactactactactacggtatggacgtctggggccaagggaccacggtcaccgtctcctca

SEQ ID NO: 28272 - protein, 128 aa, Artificial Sequence
  Description of Artificial Sequence: Synthetic polypeptide
QVQLQQSGPGLVKPSQTLSLTCAISGDSVSRNTAAWSWIRQSPSRGLEWLGRTYYRSKWYNDYAVSVKSRITINPDTSKNQFSLQLNSVTPEDTAVYYCARVNSGWSHHYYYYGMDVWGQGTTVTVSS

SEQ ID NO: 28273 - DNA, 357 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtgggtttcacacattagtagtagtggtagtaccatatattacgcagactctgtgaagggccgattcaccatctccagggacaacgccaagaactcactgtatctgcaaatgaacagcctgagagccgaggacacggccgtgtattactgtgcgagatatcggaataaccggggatacttcgatctctggggccgtggcaccctggtcactgtctcttca

SEQ ID NO: 28274 - protein, 119 aa, Artificial Sequence
  Description of Artificial Sequence: Synthetic polypeptide
QVQLVESGGGLVKPGGSLRLSCAASGFTFSDYYMSWIRQAPGKGLEWVSHISSSGSTIYYADSVKGRFTISRDNAKNSLYLQMNSLRAEDTAVYYCARYRNNRGYFDLWGRGTLVTVSS

SEQ ID NO: 28275 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgaactgggtccgccaggctccagggaaggggctggagtgggtctcagttattagtggtcgtggtggtaacacattctacgcagactccgtgaagggccggttcaccatctccagagacaattccaagaacacgctctttctgcaaatgaacagcctgagagccgaggacacggccgtatattattgtgcgtcccgtttggcagtggctggctcggaggcttttgatatctggggccaagggacaatggtcaccgtctcttca

SEQ ID NO: 28276 - protein, 121 aa, Artificial Sequence
  Description of Artificial Sequence: Synthetic polypeptide
EVQLLESGGGLVQPGGSLRLSCAASEFTFSSYAMNWVRQAPGKGLEWVSVISGRGGNTFYADSVKGRFTISRDNSKNTLFLQMNSLRAEDTAVYYCASRLAVAGSEAFDIWGQGTMVTVSS

SEQ ID NO: 28277 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccagccaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctgtgtattactgtgcgagagaactggggttccggtctgactactggggccagggaaccctggtcaccgtctcctca

SEQ ID NO: 28278 - protein, 117 aa, Artificial Sequence
  Description of Artificial Sequence: Synthetic polypeptide
QVQLVESGGGVVQPGRSLRLSCAASGFTFSNYGMHWVRQAPAKGLEWVAVIWYEENNQYYADSVKGRFTISRDNSKNTLYLQMNSLRAEDTAVYYCARELGFRSDYWGQGTLVTVSS

SEQ ID NO: 28279 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttactactggggctggatccgccagcccccagggaaggggctggagtggattgggaatatttattatagtgggagcgcctacaacaacccgtccctcaagggtcgagtcaccatatccgtagacacgtccaagaaccagttctccctgaagctgaactctgtgaccgccgcagacacggctgtgtattactgtgggagacatggaaaagactggggccttgactactggggccagggaaccctggtcaccgtctcctca

SEQ ID NO: 28280 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSAYNNPSLKGRVTISVDTSKNQFSLKLNSVTAADTAVYYCGRHGKDWGLDYWGQGTLVTVSS

SEQ ID NO: 28281 - DNA, 351 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcactgggtccgccaggctccaggcaaggggctggagtgggtggcagttatttggtatgaagaaaataatcaatactatgcagactccgtgaagggccgattcaccgtctccagagacaattccaagaacacgctgtttctgcaaatgaacagcctgagagccgaggacacggctgtgtattactgtgcgagagaactggggttccggtctgactactggggccagggaaccctggtcaccgtctcctca

SEQ ID NO: 28282 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEENNQYYADSVKGRFTVSRDNSKNTLFLQMNSLRAEDTAVYYCARELGFRSDYWGQGTLVTVSS

SEQ ID NO: 28283 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatgacatgcactgggtccgccaggctccaggcaaggggctggagtgggtggcagttatatggtatgacggaagtgataaatactatgcagactccgtgaagggccgattcaccatctccagagacaattccaagaacacgctctttctgcaaatgaacagcctgagagccgaggacacggctgtgtattactgtgcgagagatcgggcctatagcagctcgtctgactactggggccagggaaccctggtcaccgtctcctca

SEQ ID NO: 28284 - protein, 119 aa, Artificial Sequence
  Description of Artificial Sequence: Synthetic polypeptide
QVQLVESGGGVVQPGRSLRLSCAASGFTFSSYDMHWVRQAPGKGLEWVAVIWYDGSDKYYADSVKGRFTISRDNSKNTLFLQMNSLRAEDTAVYYCARDRAYSSSSDYWGQGTLVTVSS

SEQ ID NO: 28285 - DNA, 354 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagctatggcatgcactgggtccgccaggctccaggcaaggggctggagtggggggcagttatatggcatgatggaagtaataaatactatgcagactccgtgaagggccgattcaccatctccagagacaatgccaagaacacgctgtatctgcaaatgaacagcctgagagccgaggacacggctgtgtattactgtgcgagagatctgagtatgggcggaatggacgtctggggccaagggaccacggtcaccgtctcctca

SEQ ID NO: 28286 - protein, 118 aa, Artificial Sequence
  Description of Artificial Sequence: Synthetic polypeptide
QVQLVESGGGVVQPGRSLRLSCVASGFTFSSYGMHWVRQAPGKGLEWGAVIWHDGSNKYYADSVKGRFTISRDNAKNTLYLQMNSLRAEDTAVYYCARDLSMGGMDVWGQGTTVTVSS

SEQ ID NO: 28287 - DNA, 351 bp, Artificial Sequence
  Description of Artificial Sequence: Synthetic polynucleotide
caggtgcagatggtggagtctgggggaggcgtggtccagcctgggaggtccctgagactctcttgtgaagcgtctggattcaccttcagtagctatggcatgcactgggtccgccaggctccaggcaaggggctggagtgggtggcagttatatggtatgaggaaaataataaatactatgtagactccgtgaagggccgattcaccatctccagagacaattccaagagcacgctgtatctgcaaatgaatagcctgagagccgaggacacggctgtgtattactgtgtgagagaactaggcttccagtctgactactggggccagggaaccccggtcaccgtctcctca

SEQ ID NO: 28288 - protein, 117 aa, Artificial Sequence
  Description of Artificial Sequence: Synthetic polypeptide
QVQMVESGGGVVQPGRSLRLSCEASGFTFSSYGMHWVRQAPGKGLEWVAVIWYEENNKYYVDSVKGRFTISRDNSKSTLYLQMNSLRAEDTAVYYCVRELGFQSDYWGQGTPVTVSS

SEQ ID NO: 28289 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaatttacctttagcagctatgccatgaactgggtccgccaggctccagggaaggggctggagtgggtctcagttattagtggccgtggtggtaacacattctacgcagactccgtgaagggccggttcaccatctccagagacaattccaagaacacgctgtatctgcaaatgaacagcctgagagccgaggacacggccgtatattactgtgcgtcccgtttggcagtggctggctcggaggcttttgatatctggggccaagggacaatggtcaccgtctcttca

SEQ ID NO: 28290 - protein, 121 aa, Artificial Sequence
  Description of Artificial Sequence: Synthetic polypeptide
EVQLLESGGGLVQPGGSLRLSCAASEFTFSSYAMNWVRQAPGKGLEWVSVISGRGGNTFYADSVKGRFTISRDNSKNTLYLQMNSLRAEDTAVYYCASRLAVAGSEAFDIWGQGTMVTVSS

SEQ ID NO: 28291 - DNA, 351 bp, Artificial Sequence
  Description of Artificial Sequence: Synthetic polynucleotide
caggtgcaactggtggagtctgggggaggcgtggtccagcctgggaggtccctgagactctcctgtgtagcgtctggattcaccttcagtgactatggcatgcactgggtccgccaggctccaggcaaggggctggagtggatggcagttatatggtatgatgtaactaataaatactatgcagactccgtgaagggccgattcaccatctccagagacaattccaagaacacgctgtatctgcaaatgaacagcctgagcgccgaggacacggctgtttattactgtgcgagagagcttggctggtacgaggactactggggccagggaaccctggtcaccgtctcctca

SEQ ID NO: 28292 - protein, 117 aa, Artificial Sequence
  Description of Artificial Sequence: Synthetic polypeptide
QVQLVESGGGVVQPGRSLRLSCVASGFTFSDYGMHWVRQAPGKGLEWMAVIWYDVTNKYYADSVKGRFTISRDNSKNTLYLQMNSLSAEDTAVYYCARELGWYEDYWGQGTLVTVSS

SEQ ID NO: 28293 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctccggtggcgccatcagcggtagtagttactactggggctggatccgccagcccccagggaaacaactggagtggattgggaatatctattatagtgggagcacctactacaacccgtccttcaagagtcgagtcaccatatccgtagacacgtccaagaaccagttctccctgaagctgagctctgtgaccgccgaagacacggctgtctattactgtgcgagacattccagtagctggtcccttgactactggggccagggaaccctggtcaccgtctcctct

SEQ ID NO: 28294 - protein, 119 aa, Artificial Sequence
  Description of Artificial Sequence: Synthetic polypeptide
QVQLQESGPGLVKPSETLSLTCTVSGGAISGSSYYWGWIRQPPGKQLEWIGNIYYSGSTYYNPSFKSRVTISVDTSKNQFSLKLSSVTAEDTAVYYCARHSSSWSLDYWGQGTLVTVSS

SEQ ID NO: 28295 - DNA, 363 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagcagctatgccatgaactgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgaaaaggatagcagcagctggtacggagtacttcgatctctggggccgtggcaccctggtcactgtctcctca

SEQ ID NO: 28296 - protein, 121 aa, Artificial Sequence
  Description of Artificial Sequence: Synthetic polypeptide
EVQLLESGGGLVQPGGSLRLSCAASGFTFSSYAMNWVRQAPGKGLEWVSVISGSGGSTYYADSVKGRFTISRDNSKNTLYLQMNSLRAEDTAVYYCAKRIAAAGTEYFDLWGRGTLVTVSS

SEQ ID NO: 28297 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctatttattactgtgcgagagaactggggttccggtctgactactggggccagggaaccctggtcaccgtctcctca

SEQ ID NO: 28298 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEENNQYYADSVKGRFTISRDNSKNTLYLQMNSLRAEDTAIYYCARELGFRSDYWGQGTLVTVSS

SEQ ID NO: 28299 - DNA, 336 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagaatgaactggttccgccaggctccagggaaggggctggagtgggtctcatccattagtggtagtagtactgacatatactacgcagactcagtgaagggccgattcaccatctccagagacaacgccgagaactcactgtatctgcaaatgaacagcctgagagccgaggacacggctgtgtattactgtgcgagaagggacttctggggccagggaaccctggtcaccgtctcctca

SEQ ID NO: 28300 - protein, 112 aa, Artificial Sequence
  Description of Artificial Sequence: Synthetic polypeptide
EVQLVESGGGLVKPGGSLRLSCAASGFTFSSYRMNWFRQAPGKGLEWVSSISGSSTDIYYADSVKGRFTISRDNAENSLYLQMNSLRAEDTAVYYCARRDFWGQGTLVTVSS

SEQ ID NO: 28301 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgaactgggtccgccaggctccaggcaaggggctggagtgggtggcagttatatggtatgatggaaataataaacactatgcagactccgtgaagggccgattcaccatctccagagacaattccaagaacacgctgtatctgcaaatgaacagcctgagagccgaggacacggctgtgtattactgtgcgagtagtgggagctacttctttgactactggggccagggaaccctggtcaccgtctcctca

SEQ ID NO: 28302 - protein, 117 aa, Artificial Sequence
  Description of Artificial Sequence: Synthetic polypeptide
QVQLVESGGGVVQPGRSLRLSCAASGFTFSNYGMNWVRQAPGKGLEWVAVIWYDGNNKHYADSVKGRFTISRDNSKNTLYLQMNSLRAEDTAVYYCASSGSYFFDYWGQGTLVTVSS

SEQ ID NO: 28303 - DNA, 351 bp, Artificial Sequence
  Description of Artificial Sequence: Synthetic polynucleotide
caggtgcagctggtggagtctgggggaggcgtggtccagcctgggaagtccctgagactctcctgtgcagcgtctggattcaccttcagtgactatggcatgcactgggtccgccaggctccaggcaaggggctggagtgggtggcagttatatggtttgatggaagtaataaatactatgcagactccgtgaagggccgattcaccatctccagagacaattccaagaacacgctgtatctgcaaatgaacagcctgagagccgagggcacggctgtgtattactgtgcgagagatcttggctggacggaagaatactggggccagggaaccctggtcaccgtctcctca

SEQ ID NO: 28304 - protein, 117 aa, Artificial Sequence
  Description of Artificial Sequence: Synthetic polypeptide
QVQLVESGGGVVQPGKSLRLSCAASGFTFSDYGMHWVRQAPGKGLEWVAVIWFDGSNKYYADSVKGRFTISRDNSKNTLYLQMNSLRAEGTAVYYCARDLGWTEEYWGQGTLVTVSS

SEQ ID NO: 28305 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtttgatggaagtaataaatactatgtagactccgtgaagggccgattcaccatctccagagacaattccaagaacacgctgtatctgcaaatgaacagcctgagagtcgaggacacggctgtgtattactgtgcgagagatcttggctggacggaagagtactggggccagggaaccctggtcaccgtctcctca

SEQ ID NO: 28306 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFDGSNKYYVDSVKGRFTISRDNSKNTLYLQMNSLRVEDTAVYYCARDLGWTEEYWGQGTLVTVSS

SEQ ID NO: 28307 - DNA, 351 bp, Artificial Sequence
  Description of Artificial Sequence: Synthetic polynucleotide
gaggtgcagctggtggagtctgggggaggcttggtacagcctggggggtccctgagactcctctgtgcagcctctggaatcaccttcagtacctatagcatgaactgggtccgccaggctccagggaaggggctggagtgggtttcatacattagtaggagtagtagtaccatagactacgcagactctgtgaagggccgattcaccatctccagagacaatgccaagaactcactgtatctgcaaatgaacagcctgagagacgaggacacggctgtgtattactgtgcgagaggaggtgggagcccttttgactactggggccagggaaccctggtcaccgtctcctca

SEQ ID NO: 28308 - protein, 117 aa, Artificial Sequence
  Description of Artificial Sequence: Synthetic polypeptide
EVQLVESGGGLVQPGGSLRLLCAASGITFSTYSMNWVRQAPGKGLEWVSYISRSSSTIDYADSVKGRFTISRDNAKNSLYLQMNSLRDEDTAVYYCARGGGSPFDYWGQGTLVTVSS

SEQ ID NO: 28309 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcagttatatggtttgatggaagtgataaatactatgcagactccgtgaagggccgattcaccatctccagagacaattccaagaacacgctgtatctacaaatgaacagcctgagagccgaggacacggctgtgtattactgtgcgagagatcgggcctatagtagctcgtctgactactggggccagggaaccctggtcaccgtctcctca

SEQ ID NO: 28310 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVIWFDGSDKYYADSVKGRFTISRDNSKNTLYLQMNSLRAEDTAVYYCARDRAYSSSSDYWGQGTLVTVSS

SEQ ID NO: 28311 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgacctgggtccgccagggtccagggatggggctggagtgggtctcagttataagtggtagtggtggttacacatacaacgcggactccgtgaagggccggttcaccatctccagagacaattccaagaacacgctgtatctgcaaatgaacagcctgagagtcgaggacacggccgtatattactgtgcgtcccgtatagcagtggctggctcggaggcttttgatatctggggccaagggacaatggtcaccgtctcttca

SEQ ID NO: 28312 - protein, 121 aa, Artificial Sequence
  Description of Artificial Sequence: Synthetic polypeptide
EVQLLESGGGLVQPGGSLRLSCAASGFTFSSYAMTWVRQGPGMGLEWVSVISGSGGYTYNADSVKGRFTISRDNSKNTLYLQMNSLRVEDTAVYYCASRIAVAGSEAFDIWGQGTMVTVSS

SEQ ID NO: 28313 - DNA, 351 bp, Artificial Sequence
  Description of Artificial Sequence: Synthetic polynucleotide
caggtgcagctggtggagtctgggggaggcctggtccagcctgggaggtccctgagactctcctgtgcagcgtctggattcaccttcagtaactatggcatgcactgggtccgccaggctccaggcaaggggctggagtgggtggcagttatatggtatgagggaagtaataaatattatgtagactccgtgaggggccgattcaccatctccagagacaattccaagagcacgctgtatctgcaaatgaacagcctgagagccgaggacacggctgtgtattactgtgtgagagagctaggcttccagtctgatcactggggccagggaaccccggtcaccgtctcctca

SEQ ID NO: 28314 - protein, 117 aa, Artificial Sequence
  Description of Artificial Sequence: Synthetic polypeptide
QVQLVESGGGLVQPGRSLRLSCAASGFTFSNYGMHWVRQAPGKGLEWVAVIWYEGSNKYYVDSVRGRFTISRDNSKSTLYLQMNSLRAEDTAVYYCVRELGFQSDHWGQGTPVTVSS

SEQ ID NO: 28315 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgaactgggtccgccaggctccagggaaggggctggagtgggtctcaattattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtttggcagtggctggctcggaggcttttgatatctggggccaagggacaatggtcaccgtctcttca

SEQ ID NO: 28316 - protein, 121 aa, Artificial Sequence
  Description of Artificial Sequence: Synthetic polypeptide
EVQLLESGGGLVQPGGSLRLSCAASEFTFSSYAMNWVRQAPGKGLEWVSIISGRGGNTFYADSVKGRFTISRDNSKNTLYLQMNSLRAEDTAVYYCASRLAVAGSEAFDIWGQGTMVTVSS

SEQ ID NO: 28317 - DNA, 363 bp, Artificial Sequence
  Description of Artificial Sequence: Synthetic polynucleotide
gaggcgcagctgttggagtctgggggaggcttggaacagcctggggggtccctgagactctcctgtgcagcctctggattcacctttagcagctatgccatgagctgggtccgccaggctccagggaaggggctggagtgggtctcagttattagtggtagaggtggtaacacatactccgcagactccgtgaagggccggttcaccatctccagagacaattccaagaacacgctatatctacaaatgaacagcctgagagccgaggacacggccgtatattactgtgcgtcccgtttagcagtggctggctcggaggcttttcatatctggggccaagggacaatggtcaccgtctcttca

SEQ ID NO: 28318 - protein, 121 aa, Artificial Sequence
  Description of Artificial Sequence: Synthetic polypeptide
EAQLLESGGGLEQPGGSLRLSCAASGFTFSSYAMSWVRQAPGKGLEWVSVISGRGGNTYSADSVKGRFTISRDNSKNTLYLQMNSLRAEDTAVYYCASRLAVAGSEAFHIWGQGTMVTVSS

SEQ ID NO: 28319 - DNA, 357 bp, Artificial Sequence
  Description of Artificial Sequence: Synthetic polynucleotide
cagctgcagctgcaggagtcgggcccaggactggtgaagttttcggagaccctgtccctcacctgcactgtctctggtggctccatcagcagaagtagttattactggggctggatccgccagcccccagggaaggggctggagtggatagggaatatctattatagtgggtatacctactacactccgtccctcaagagtcgagtcaccatatccgtagacacgtccaagaaccagttctccctgaagctgagctctgtgaccgccgcagacacggctgtgtattactgtgcgagacatagcaccagctggtcccttgactactggggccagggaaccctggtcaccgtctcctca

SEQ ID NO: 28320 - protein, 119 aa, Artificial Sequence
  Description of Artificial Sequence: Synthetic polypeptide
QLQLQESGPGLVKFSETLSLTCTVSGGSISRSSYYWGWIRQPPGKGLEWIGNIYYSGYTYYTPSLKSRVTISVDTSKNQFSLKLSSVTAADTAVYYCARHSTSWSLDYWGQGTLVTVSS

SEQ ID NO: 28321 - DNA, 351 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagaagctatagcatgaactgggtccgccaggctccagggaaggggctggagtggctttcatacattagtagtagtagtggtaccatatactacgcagactctgtgaagggccgattcaccatctccagagacaacgccaggaactcactgaatctgcaaatgaacagcctgagagacgaggacacggctgtgtattactgtgcgagaggaggtgggagcccttttgactactggggccagggaatcctggtcaccgtctcctca

SEQ ID NO: 28322 - protein, 117 aa, Artificial Sequence
  Description of Artificial Sequence: Synthetic polypeptide
EVQLVESGGGLVQPGGSLRLSCAASGFTFRSYSMNWVRQAPGKGLEWLSYISSSSGTIYYADSVKGRFTISRDNARNSLNLQMNSLRDEDTAVYYCARGGGSPFDYWGQGILVTVSS

SEQ ID NO: 28323 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaagtaataaatactatgcagactccgtgaagggccgattcaccatctccagagacaattccaagaacacgctgtatctgcaaatgaacagcctgagagccgaggacacggctgtatattactgtgcgagagagcttgcctggtacgaggactcctggggccagggaaccctggtcaccgtctcctca

SEQ ID NO: 28324 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDESNKYYADSVKGRFTISRDNSKNTLYLQMNSLRAEDTAVYYCARELAWYEDSWGQGTLVTVSS

SEQ ID NO: 28325 - DNA, 336 bp, Artificial Sequence
  Description of Artificial Sequence: Synthetic polynucleotide
gaggtgcaactgttggagtcggggggaggcttggtacagcctggggggtccctgagactctcctgtgcagcctctggattctcctttagtagctatgccatgacctgggtccgccaggctccagggaaggggctggagtgggtctcaactattagtggtcgtggtggtcacacatactacgcagactccgtgaggggccggttcgccatctccagagacagttccaagaacacgctgtatctgcaaatgaacagcctgagagccgaggacacggccgtatattactgtgcgaaacaggactgctggggccagggaaccctggtcaccgtctcctca

SEQ ID NO: 28326 - protein, 112 aa, Artificial Sequence
  Description of Artificial Sequence: Synthetic polypeptide
EVQLLESGGGLVQPGGSLRLSCAASGFSFSSYAMTWVRQAPGKGLEWVSTISGRGGHTYYADSVRGRFAISRDSSKNTLYLQMNSLRAEDTAVYYCAKQDCWGQGTLVTVSS

SEQ ID NO: 28327 - DNA, 351 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaagtaataaacactatatagactccgtgaagggccgattcaccatctccagagacaattccaagaacacgctgtatctgcaaatgaacagcctgagagccgaggacacggctgtgtattattgcgtgagagaactggggttccggtttgactactggggccagggaaccctggtcaccgtctcctca

SEQ ID NO: 28328 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDESNKHYIDSVKGRFTISRDNSKNTLYLQMNSLRAEDTAVYYCVRELGFRFDYWGQGTLVTVSS

SEQ ID NO: 28329 - DNA, 345 bp, Artificial Sequence
  Description of Artificial Sequence: Synthetic polynucleotide
caggtgcagctggtgcagtctggggctgaggtgaagaagcctggggcctcagtgaaggtctcctgcaaggcgtctggatacaccttcaccagctatgctatcaactgggtgcgacaggccactggacaagggcttgagtggatgggatggatgaaccctaacactggtaacacaggctatgcacagaagttccagggcagagtcaccatgaccaggaacacctccataagcacagcctacatggagctgagcagcctgagatctgaggacacggccgtatatttctgtacgagaaaggctgggtttgactactggggccagggaaccctggtcaccgtctcctca

SEQ ID NO: 28330 - protein, 115 aa, Artificial Sequence
  Description of Artificial Sequence: Synthetic polypeptide
QVQLVQSGAEVKKPGASVKVSCKASGYTFTSYAINWVRQATGQGLEWMGWMNPNTGNTGYAQKFQGRVTMTRNTSISTAYMELSSLRSEDTAVYFCTRKAGFDYWGQGTLVTVSS

SEQ ID NO: 28331 - DNA, 363 bp, Artificial Sequence
  Description of Artificial Sequence: Synthetic polynucleotide
gaggtgcagctgttggagtctgggggaggcttgatacagcctggggggtccctgagactctcctgtgcagcctctgaattcacctttagcagctatgccatgagctgggtccgccaggatccagggaaggggctggagtgggtctcaattattagtggtcgtgggggaaacgcattctacgcagactccgtgaagggccggttcaccatctccagagacaattccaagaacacgctgtatctgcaaatgaacagcctgagagccgaggacacggccgtatattactgtgcgtcccgtatagcagtggctggctcggaggcttttgatatctggggccaagggacaatggtcaccgtctcttca

SEQ ID NO: 28332 - protein, 121 aa, Artificial Sequence
  Description of Artificial Sequence: Synthetic polypeptide
EVQLLESGGGLIQPGGSLRLSCAASEFTFSSYAMSWVRQDPGKGLEWVSIISGRGGNAFYADSVKGRFTISRDNSKNTLYLQMNSLRAEDTAVYYCASRIAVAGSEAFDIWGQGTMVTVSS

SEQ ID NO: 28333 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgagctgggtccgccaggctccagggacggggctggagtgggtctcaattattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtctggcagtggctggctcggaggcttttgatatctggggccaagggacgatggtcaccgtctcttca

SEQ ID NO: 28334 - protein, 121 aa, Artificial Sequence
  Description of Artificial Sequence: Synthetic polypeptide
EVQLLESGGGLVQPGGSLRLSCAASEFTFSSYAMSWVRQAPGTGLEWVSIISGRGGNTFYADSVKGRFTISRDNSKNTLYLQMNSLRAEDTAVYYCASRLAVAGSEAFDIWGQGTMVTVSS

SEQ ID NO: 28335 - DNA, 342 bp, Artificial Sequence
  Description of Artificial Sequence: Synthetic polynucleotide
gaggtgcagctggtggaggccgggggaggcctggtcaagccgggggggtccctgagactctcctgtgcagcctctggattcaccttcaccagctatagcatgaactgggtccgccaggctccagggaaggggctggagtgggtctcatccattagtgggagtagtagttacatatactacgcagactcagtgaagggccgattcaccatctccagagacaacgccaagaactcactgtatctgcaaatgaacagcctgagagccgaggacacggctgtgtattactgtgcgagagatcgtgggagctactggggccagggtaccctggtcaccgtctcctca

SEQ ID NO: 28336 - protein, 114 aa, Artificial Sequence
  Description of Artificial Sequence: Synthetic polypeptide
EVQLVEAGGGLVKPGGSLRLSCAASGFTFTSYSMNWVRQAPGKGLEWVSSISGSSSYIYYADSVKGRFTISRDNAKNSLYLQMNSLRAEDTAVYYCARDRGSYWGQGTLVTVSS

SEQ ID NO: 28337 - DNA, 357 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactattacatgagctggatccgccaggctccagggaaggggctggagtgggtttcacacattagtagtagtggtagtaccatatactacgcagactctgtgaagggccgattcaccatctccagggacaacggcgagaactcactgtatctgcaaatgaacagcctgagagccgaggacacggccgtgtattactgtgcgagatatcggaataaccgggggtacttcgatctctggggccgtggctccctggtcactgtctcctca

SEQ ID NO: 28338 - protein, 119 aa, Artificial Sequence
  Description of Artificial Sequence: Synthetic polypeptide
QVQLVESGGGLVKPGGSLRLSCAASGFTFSDYYMSWIRQAPGKGLEWVSHISSSGSTIYYADSVKGRFTISRDNGENSLYLQMNSLRAEDTAVYYCARYRNNRGYFDLWGRGSLVTVSS

SEQ ID NO: 28339 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgaactgggtccgccaggctccagggaaggggctggagtgggtctcagttattagtggtagtggtagtaacacatactacgcagactccgtgaagggccggttcaccatctccagagacaattccaagaacacgctgtatctgcaaatgaacagcctgagagccgaggacacggccgtatattactgtgcgaaaagatataccagtgactggcatgatgcttttgatatctggggccaagggacaatggtcaccgtctcttca

SEQ ID NO: 28340 - protein, 121 aa, Artificial Sequence
  Description of Artificial Sequence: Synthetic polypeptide
EVQLLESGGGLVQPGGSLRLSCAASGFTFSSYAMNWVRQAPGKGLEWVSVISGSGSNTYYADSVKGRFTISRDNSKNTLYLQMNSLRAEDTAVYYCAKRYTSDWHDAFDIWGQGTMVTVSS

SEQ ID NO: 28341 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtgactatggcatgcactgggtccgccaggctccaggcaaggggctggagtgggtggcacttatatggtatgatgtaactaataaatactatggagactccgtgaagggccgattcaccatctccagagacaattcccagaacacgctgtatctgcaactgaacagcctgagagccgaggacacggctgtgtattactgtgcgagagagcttggctggtacgaggactactggggccagggaaccctggtcaccgtctcctca

SEQ ID NO: 28342 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVALIWYDVTNKYYGDSVKGRFTISRDNSQNTLYLQLNSLRAEDTAVYYCARELGWYEDYWGQGTLVTVSS

SEQ ID NO: 28343 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatggcttgaactgggtccgccaggctccagggaaggggctggagtgggtctcatccattagtggtagtggtagtcacatatcctacgcggactcagtgaagggccgattcaccatctccagagacaacgccaagaactcactgtatctgcaactgaacagcctgagagccgaggacacggctgtgtattactgtgcgagagatcggggcagtggctggggccagggaaccctggtcaccgtctcctca

SEQ ID NO: 28344 - protein, 114 aa, Artificial Sequence
  Description of Artificial Sequence: Synthetic polypeptide
EVQLVESGGGLVKPGGSLRLSCAASGFTFSSYGLNWVRQAPGKGLEWVSSISGSGSHISYADSVKGRFTISRDNAKNSLYLQLNSLRAEDTAVYYCARDRGSGWGQGTLVTVSS

SEQ ID NO: 28345 - DNA, 363 bp, Artificial Sequence
  Description of Artificial Sequence: Synthetic polynucleotide
gaggtgcagctgttggagtctgggggaggcttggtacagcctggggggtccctgagactctcctgtgtagcctctggattcacctttagcagctatgccatgaactgggtccgccaggctccagggaaggggctggagtgggtctcagttattagtggtagtggtggtagcacatactacgcagactccgtgaagggccggttcaccatctccagagacaattccaagaacacgctgtatctgcaaatgaacaccctgagagccgaggacacggccgtatattactgtgcgaaaaggtataccagtgactggcatgatgcttttgatatctggggccaagggacaatggtcaccgtctcttca

SEQ ID NO: 28346 - protein, 121 aa, Artificial Sequence
  Description of Artificial Sequence: Synthetic polypeptide
EVQLLESGGGLVQPGGSLRLSCVASGFTFSSYAMNWVRQAPGKGLEWVSVISGSGGSTYYADSVKGRFTISRDNSKNTLYLQMNTLRAEDTAVYYCAKRYTSDWHDAFDIWGQGTMVTVSS

SEQ ID NO: 28347 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctgagtatgggcggtatggacgtctggggccaagggaccacggtcaccgtctcctca

SEQ ID NO: 28348 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARDLSMGGMDVWGQGTTVTVSS

SEQ ID NO: 28349 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtgactatggcatgcactgggtccgccaggctccaggcaaggggctggagtggatggcagttatatggtatgatgtaactaataaatactatgcagactccgtgaagggccgattcaccatctccagagacaattccaagaacacgctgtatctgcaaatgaacagcctgagagccgaggacacggctgtttattactgtgcgagagaggttggctggtacgaggactactggggccagggaaccctggtcaccgtctcctca

SEQ ID NO: 28350 - protein, 117 aa, Artificial Sequence
  Description of Artificial Sequence: Synthetic polypeptide
QVQLVESGGGVVQPGRSLRLSCAASGFTFSDYGMHWVRQAPGKGLEWMAVIWYDVTNKYYADSVKGRFTISRDNSKNTLYLQMNSLRAEDTAVYYCAREVGWYEDYWGQGTLVTVSS

SEQ ID NO: 28351 - DNA, 369 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtaattatgtcattcactgggtccgccaggctccaggcaagggactggagtgggtggcagttatatggtatgatggaagtaataaatactatgcagactccgtgaagggccgcttcaccatctccagagacaattccaagaacacgctgtatctgcaaatgaacagcctgagagccgaggacacggctgtgtattcctgtgcgagagagaagtatagcagcagctggtacgactacggtatggacgtctggggccaagggaccacggtcaccgtctcctca

SEQ ID NO: 28352 - protein, 123 aa, Artificial Sequence
  Description of Artificial Sequence: Synthetic polypeptide
QVQLVESGGGVVQPGRSLRLSCAASGFTFSNYVIHWVRQAPGKGLEWVAVIWYDGSNKYYADSVKGRFTISRDNSKNTLYLQMNSLRAEDTAVYSCAREKYSSSWYDYGMDVWGQGTTVTVSS

SEQ ID NO: 28353 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgacgacacggctgtgtattactgtgcgagagaactggggttccggtctgactactggggccagggaaccctggtcaccgtctcctca

SEQ ID NO: 28354 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYEENNQYYADSVKGRFTISRDNSKNTLYLQMNSLRADDTAVYYCARELGFRSDYWGQGTLVTVSS

SEQ ID NO: 28355 - DNA, 345 bp, Artificial Sequence
  Description of Artificial Sequence: Synthetic polynucleotide
gaggtgcacctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagtttcatatactacgcagactcagtgaagggccgattcaccatctccagagacaacgccaagaactcactgtatctgcaaatgaacagcctgagagccgaggacacggctgtgtattactgtgcgagagtagcagctcttgactactggggccagggaaccctggtcaccgtctcctca

SEQ ID NO: 28356 - protein, 115 aa, Artificial Sequence
  Description of Artificial Sequence: Synthetic polypeptide
EVHLVESGGGLVKPGGSLRLSCAASGFTFSSYSMNWVRQAPGKGLEWVSSISGSSSFIYYADSVKGRFTISRDNAKNSLYLQMNSLRAEDTAVYYCARVAALDYWGQGTLVTVSS

SEQ ID NO: 28357 - DNA, 339 bp, Artificial Sequence
  Description of Artificial Sequence: Synthetic polynucleotide
gaggtgcagctggtggagtctgggggaggcctggtcaagcctggggggtccctaagactctcctgtgcagcctctggattcaccttcagtagctatagcgtgaactgggtccgccgggctccagggaaggggctggagtgggtctcatccattagtagtagtagtagtttcctatactacgcagactcagtgaagggccgattcaccatctccagagacaacgccaagaactcagtgtatctgcaaatgaacagcctgagagccgaggacacggctgtatattactgtgcgagaaactgggactactggggccagggaaccctggtcaccgtctcctca

SEQ ID NO: 28358 - protein, 113 aa, Artificial Sequence
  Description of Artificial Sequence: Synthetic polypeptide
EVQLVESGGGLVKPGGSLRLSCAASGFTFSSYSVNWVRRAPGKGLEWVSSISSSSSFLYYADSVKGRFTISRDNAKNSVYLQMNSLRAEDTAVYYCARNWDYWGQGTLVTVSS

SEQ ID NO: 28359 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagcgatgacatgcactgggtccgccaggctccaggcaaggggctggagtgggtggcagttatatggtttgatggaagtaataaatactatgcagactccgtgaagggccgattcatcatctccagagacaattccaagaacacgctgtatctgcaaatgaacagcctgagagccgaggacacggctatgtattactgtgcgagagatctaatagcagcagctggtacggttgactactggggccagggaaccctggtcaccgtctcctca

SEQ ID NO: 28360 - protein, 120 aa, Artificial Sequence
  Description of Artificial Sequence: Synthetic polypeptide
QVQLVESGGGVVQPGRSLRLSCAASGFTLSSDDMHWVRQAPGKGLEWVAVIWFDGSNKYYADSVKGRFIISRDNSKNTLYLQMNSLRAEDTAMYYCARDLIAAAGTVDYWGQGTLVTVSS

SEQ ID NO: 28361 - DNA, 348 bp, Artificial Sequence
  Description of Artificial Sequence: Synthetic polynucleotide
caggtgcagctggtggagtctgggggaggcgtggtccagcctgggaggtccctgagactctcctgtgttgcctctggattcaccttcagtagctatggcatgcactgggtccgccaggctccaggcaaggggctggagtgggtgacagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaggggtatggttcggggacctctggggccagggaaccctggtcaccgtctcctca

SEQ ID NO: 28362 - protein, 116 aa, Artificial Sequence
  Description of Artificial Sequence: Synthetic polypeptide
QVQLVESGGGVVQPGRSLRLSCVASGFTFSSYGMHWVRQAPGKGLEWVTVISYDGSNKYYADSVKGRFTISRDNSKNTLYLQMNSLRAEDTAVYYCARGVWFGDLWGQGTLVTVSS

SEQ ID NO: 28363 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtgactatggcatgcactgggtccgccaggctccaggcaaggggctggagtggatggcagttatatggtatgatgtaactaatgaatactatgcagactccgtgaagggccgattcaccatctccagagacaattccaagaacacgctgtatctgcaaatgaacagcctgagagccgaggacacggctgtttattactgtgcgagagagcttggctggtacgaggactactggggccagggaaccctggtcaccgtctcctca

SEQ ID NO: 28364 - protein, 117 aa, Artificial Sequence
  Description of Artificial Sequence: Synthetic polypeptide
QVQLVESGGGVVQPGRSLRLSCAASGFTFSDYGMHWVRQAPGKGLEWMAVIWYDVTNEYYADSVKGRFTISRDNSKNTLYLQMNSLRAEDTAVYYCARELGWYEDYWGQGTLVTVSS

SEQ ID NO: 28365 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgaactgggtccgccaggctccagggaaggggctggagtgggtctcaattattagtggtcgtggtgttaacacattctacgcagactccgtgaagggccggttcaccatctccagagacaattccaagaacacgctgtatctgcaaatgaacagcctgagagccgaggacacggccgtatattactgtgcgtcccgtttggcagtggctggctcggaggcttttgatatctggggccaagggacaatggtcaccgtctcttca

SEQ ID NO: 28366 - protein, 121 aa, Artificial Sequence
  Description of Artificial Sequence: Synthetic polypeptide
EVQLLESGGGLVQPGGSLRLSCAASEFTFSSYAMNWVRQAPGKGLEWVSIISGRGVNTFYADSVKGRFTISRDNSKNTLYLQMNSLRAEDTAVYYCASRLAVAGSEAFDIWGQGTMVTVSS

SEQ ID NO: 28367 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggatggggctggagtgggtctcagttattagtcgtagtggtggttacacatactacgcggactccgtgaagggccggttcaccatctccagagacaattccaagaacacgctgtatctgcaaatgaacagcctgagagccgaggacacggccgtctattactgtgcgtcccgtttagcagtggctggctcggaggcttttgatatctggggccaagggacactggtcaccgtctcttca

SEQ ID NO: 28368 - protein, 121 aa, Artificial Sequence
  Description of Artificial Sequence: Synthetic polypeptide
EVQLLESGGGLVQPGGSLRLSCAASGFTFSSYAMNWVRQAPGMGLEWVSVISRSGGYTYYADSVKGRFTISRDNSKNTLYLQMNSLRAEDTAVYYCASRLAVAGSEAFDIWGQGTLVTVSS

SEQ ID NO: 28369 - DNA, 363 bp, Artificial Sequence
  Description of Artificial Sequence: Synthetic polynucleotide
gaggtgcagctgttggagtctgggggagacttggtacagcctggggggtccctgagactctcctgtacagcctctggattcacctttagcagctatgccatgaactgggtccgccaggctccagggaaggggctggagtgggtctcagttattagtggtagtggtggtaacacattctacgcagactccgtgaagggccgattcaccatctccagagacaattccaagaacacgctgtttctgcacatgaacagcctgagagccgaggacacggccgtttattactgtgcgtcccgtatggcagtggctggctcggaggcttttgatatctggggccaagggacaatggtcaccgtctcttca

SEQ ID NO: 28370 - protein, 121 aa, Artificial Sequence
  Description of Artificial Sequence: Synthetic polypeptide
EVQLLESGGDLVQPGGSLRLSCTASGFTFSSYAMNWVRQAPGKGLEWVSVISGSGGNTFYADSVKGRFTISRDNSKNTLFLHMNSLRAEDTAVYYCASRMAVAGSEAFDIWGQGTMVTVSS

SEQ ID NO: 28371 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagttattagtggtagtggtggtaccacatacttcgcagactccgtgaagggccggttcaccatctccagagacaattccaagaacacgctgtatctgcaaatgaacagcctgagagccgaggacacggccgtatattactgtgcgaaaagaaatagcagtggctggcatgatgtttttgatatctggggccaagggacaaaggtcaccgtctcttca

SEQ ID NO: 28372 - protein, 121 aa, Artificial Sequence
  Description of Artificial Sequence: Synthetic polypeptide
EVQLLESGGGLVQPGGSLRLSCAASGFTFSSYAMNWVRQAPGKGLEWVSVISGSGGTTYFADSVKGRFTISRDNSKNTLYLQMNSLRAEDTAVYYCAKRNSSGWHDVFDIWGQGTKVTVSS

SEQ ID NO: 28373 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgaactgggtccgccaggctccagggaaggggctggagtgggtctcatccatcagtggcagtggtagtcacatatactacgcggactcagtgaagggccgattcaccatctccagagacaacgccaagaactcactgtatctgcaaatgaacagcctgagagccgaggacacggctgtgtattactgtgcgagagatcggggcagtggctggggccagggaaccctggtcaccgtctcctca

SEQ ID NO: 28374 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSGSHIYYADSVKGRFTISRDNAKNSLYLQMNSLRAEDTAVYYCARDRGSGWGQGTLVTVSS

SEQ ID NO: 28375 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacttttagcagctatgccatgaactgggtccgccaggctccagggaaggggctggagtgggtctcagttattagtggtagtggtggtaccacatactacgcagactccgtgaagggccggttcaccatctccagagacaattccaagaacacgctgtatctgcaaatgaacaccctgagagccgaggacacggccgtatattactgtgcgaaaaggtataccagtgactggcatgatgcttttgatatctggggccaagggacaatggtcaccgtctcttca

SEQ ID NO: 28376 - protein, 121 aa, Artificial Sequence
  Description of Artificial Sequence: Synthetic polypeptide
EVQLLESGGGLVQPGGSLRLSCAASGFTFSSYAMNWVRQAPGKGLEWVSVISGSGGTTYYADSVKGRFTISRDNSKNTLYLQMNTLRAEDTAVYYCAKRYTSDWHDAFDIWGQGTMVTVSS

SEQ ID NO: 28377 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatgtggtatgatgaaagtaataaacactatgcagactccgtgaagggccgattcaccatctccagagacaattccaggaacacgctgtatctgcaaatgaacagcctgagagccgaggacacggctgtgtattactgtgcgagagaactggggttccggtttgactactggggccagggaaccctggtcaccgtctcctca

SEQ ID NO: 28378 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVMWYDESNKHYADSVKGRFTISRDNSRNTLYLQMNSLRAEDTAVYYCARELGFRFDYWGQGTLVTVSS

SEQ ID NO: 28379 - DNA, 357 bp, Artificial Sequence
  Description of Artificial Sequence: Synthetic polynucleotide
cagctgcagctgcaggagtcgggcccaggactggtgaagcctgcggagaccctgtccctcacctgcactgtctctggtggctccatcagcagaagtagttactactggggctggatccgccagcccccagggaaggtgctggagtggattgggagcatctattatagtgggagcacctactacaacccgtccctcaagagtcgagtcaccatatccgtcgacacgtccaagaaccagttctccctgaagctgagctctgtgaccgccgcagacacggctgagtattactgtgcgagccttagcagcagctgggacttccagcactggggccagggcaccctggtcaccgtctcctca

SEQ ID NO: 28380 - protein, 119 aa, Artificial Sequence
  Description of Artificial Sequence: Synthetic polypeptide
QLQLQESGPGLVKPAETLSLTCTVSGGSISRSSYYWGWIRQPPGKVLEWIGSIYYSGSTYYNPSLKSRVTISVDTSKNQFSLKLSSVTAADTAEYYCASLSSSWDFQHWGQGTLVTVSS

SEQ ID NO: 28381 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcaatagctatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctctgtattactgtgcgagagcggctggctttgactactggggccagggaaccctggtcaccgtctcctca

SEQ ID NO: 28382 - protein, 115 aa, Artificial Sequence
  Description of Artificial Sequence: Synthetic polypeptide
EVQLVESGGGLVKPGGSLRLSCAASGFTFNSYSMNWVRQAPGKGLEWVSSISGSSSYIYYADSVKGRFTISRDNAKNSLYLQMNSLRAEDTALYYCARAAGFDYWGQGTLVTVSS

SEQ ID NO: 28383 - DNA, 342 bp, Artificial Sequence
  Description of Artificial Sequence: Synthetic polynucleotide
gcggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgttttactgtgcgagagataggggcagcctctggggccagggaaccctggtcaccgtctcctct

SEQ ID NO: 28384 - protein, 114 aa, Artificial Sequence
  Description of Artificial Sequence: Synthetic polypeptide
AVQLVESGGGLVKPGGSLRLSCAASGFTFSSYSMNWVRQAPGKGLEWVSSISSSSSYIYYADSVKGRFTISRDNAKNSLYLQMNSLRAEDTAVFYCARDRGSLWGQGTLVTVSS

SEQ ID NO: 28385 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctgtgtattactgtgcgagagaagtggggttccggtctgactactggggccagggaaccctggtcaccgtctcctca

SEQ ID NO: 28386 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYEENNQYYADSVKGRFTISRDNSKNTLYLQMNSLRAEDTAVYYCAREVGFRSDYWGQGTLVTVSS

SEQ ID NO: 28387 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagcagctatagcatgaactgggtccgccaggctccagggaaggggctggagtgggtctcatccattagtggtagtagtagttacacatactacgcagactcagtgaagggccgattcaccatctccagagacaacgccaagaactcactgtatctgcaaatgaacagcctgagagccgaggacacggctgtgtattactgtgcgagagtagcagcccttgactcctggggccagggaaccctggtcaccgtctcctca

SEQ ID NO: 28388 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYTYYADSVKGRFTISRDNAKNSLYLQMNSLRAEDTAVYYCARVAALDSWGQGTLVTVSS

SEQ ID NO: 28389 - DNA, 345 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgttatgagctgggtccgccaggctccagggaaggggctggagtgggtctcagctatgagtggtagtggtggtagcacatattatgtagactccgtgaagggccggttcaccatctccagagacaattccaagaacacgctgtatctgcaaatgaacagcctgagagccgaggacacggccgtatattattgtgcgcgaactggggtctttgactactggggccagggaaccctggtcatcgtctcctca

SEQ ID NO: 28390 - protein, 115 aa, Artificial Sequence
  Description of Artificial Sequence: Synthetic polypeptide
EVQLLESGGGLVQPGGSLRLSCAASGFTFSSYVMSWVRQAPGKGLEWVSAMSGSGGSTYYVDSVKGRFTISRDNSKNTLYLQMNSLRAEDTAVYYCARTGVFDYWGQGTLVIVSS

SEQ ID NO: 28391 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaggttccagggcagagtcaccatgaccaggaacacctccataagcacagcctacatggagctgagcagcctgagatctgaggacacggccgtgtattactgtgcgacaagcagtggctgggaggtctttgactactggggccagggaaccctggtcaccgtctcctca

SEQ ID NO: 28392 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQRFQGRVTMTRNTSISTAYMELSSLRSEDTAVYYCATSSGWEVFDYWGQGTLVTVSS

SEQ ID NO: 28393 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaagggcctggagtgggtctcatccattagtggcagtagtagttacatatactacgcagactcagtgaaggcccgattcaccatctccagagacaacgccaagaactcactgtatctgcaaatgaacagcctgagagccgaggacacggctgtgtattactgtgcgagagacagaggcagtctctggggccagggaaccctggtcaccgtctcctca

SEQ ID NO: 28394 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKARFTISRDNAKNSLYLQMNSLRAEDTAVYYCARDRGSLWGQGTLVTVSS

SEQ ID NO: 28395 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtttgatggaagtaataaatactatgtagactccgtgaagggccgattcaccatctccagagacgattccaagaacactctgtatctgcaaatgaacagcctgagagccgaggacacggctgtgtattactgcgcgagagatcttggctggacggaagagtactggggccagggaaccctggtcaccgtctcctca

SEQ ID NO: 28396 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFDGSNKYYVDSVKGRFTISRDDSKNTLYLQMNSLRAEDTAVYYCARDLGWTEEYWGQGTLVTVSS

SEQ ID NO: 28397 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagcggtagtagtagttacatctactacgcagactcactgaagggccgattcaccatctccagagacaacgccaagaactcactgtatctgcaaatgaacagcctgagagccgaggacacggctgtgtattactgtgcgagagatcgtgggagctactggggccagggaaccctggtcaccgtctcctca

SEQ ID NO: 28398 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSLKGRFTISRDNAKNSLYLQMNSLRAEDTAVYYCARDRGSYWGQGTLVTVSS

SEQ ID NO: 28399 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttactactggggctggatccgccagcccccagggaaggggctggagtggattgggaatatttattatagtgggagcacctacgacaacccgtccctcaagagtcgagtcaccatatccgtagacacgtccaagaaccagttctccctgaagctgagctctgtgaccgccgcggacacggctgtttattactgtgggagacatggaaaagactggggccttgactactggggccagggaaccctggtcaccgtctcctca

SEQ ID NO: 28400 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYDNPSLKSRVTISVDTSKNQFSLKLSSVTAADTAVYYCGRHGKDWGLDYWGQGTLVTVSS

SEQ ID NO: 28401 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatacactgggtccgccaggctccaggcaaggggctggagtgggtggcagttatatggtttgatggaagtaataaatactatgcagactccgtgaagggccgaatcaccatctctagagacaattccaagaacacgctgtatctgcaaatgaacagcctgagagccgaggacacggctgtgtattactgtgcgagagatcttggctggacggaagagtactggggccagggaaccctggtcaccgtctcctca

SEQ ID NO: 28402 - protein, 117 aa, Artificial Sequence
  Description of Artificial Sequence: Synthetic polypeptide
QVQLVESGGGVVQPGRSLRLSCAASGFTFSDYGIHWVRQAPGKGLEWVAVIWFDGSNKYYADSVKGRITISRDNSKNTLYLQMNSLRAEDTAVYYCARDLGWTEEYWGQGTLVTVSS

SEQ ID NO: 28403 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtggggggcagttatatggcatgatggaagtaataaatactatgcagactccgtgaagggccgattcaccatctccagagacaatgccaagaacacgctgtatctgcaaatgaacagcctgagagccgaggacacggctgtgtattactgtgcgagagatctgagtatgggcggtatggacgtctggggccaagggaccacggtcaccgtctcctca

SEQ ID NO: 28404 - protein, 118 aa, Artificial Sequence
  Description of Artificial Sequence: Synthetic polypeptide
QVQLVESGGGVVQPGRSLRLSCAASGFTFSSYGMHWVRQAPGKGLEWGAVIWHDGSNKYYADSVKGRFTISRDNAKNTLYLQMNSLRAEDTAVYYCARDLSMGGMDVWGQGTTVTVSS

SEQ ID NO: 28405 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcaggagtagttactactggggctggatccgccagcccccagggaaggggctggagtggattggaaatatctattatagtgggaccacctcctacaacccgtccctcaagagtcgagtcaccatatccgttgacacgtccaggaaccagttctccctgaagctgagctctgtgaccgccgcagacacggctgtgttttactgtgcgagactcagcagcagctggtccgttgactactggggccagggaaccctggtcaccgtctcctca

SEQ ID NO: 28406 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGTTSYNPSLKSRVTISVDTSRNQFSLKLSSVTAADTAVFYCARLSSSWSVDYWGQGTLVTVSS

SEQ ID NO: 28407 - DNA, 345 bp, Artificial Sequence
  Description of Artificial Sequence: Synthetic polynucleotide
gaggtgcagctgttggagtctgggggaggcttggtacagcctggggggtccctgagactctcctgtacagcctctggattcacctttagcagctatgccatgaactgggtccgccaggctccagggaaggggctggagtgggtctcagctattagtggtagtggtggtttcacatactacgcagactccgtgaagggccggttcaccatctccagagacaattccaggaacacgctgtatctgcaaatgaacagcctgagagccgaggacacggccgtatattactgtgcgcgtaccagtggctttgactactggggccagggaaccctggtcaccgtctcctca

SEQ ID NO: 28408 - protein, 115 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGFTYYADSVKGRFTISRDNSRNTLYLQMNSLRAEDTAVYYCARTSGFDYWGQGTLVTVSS

SEQ ID NO: 28409 - DNA, 354 bp, Artificial Sequence
  Description of Artificial Sequence: Synthetic polynucleotide
caggtgcagctggtggagtctgggggaggcgtggtccagcctgggaggtccctgagactctcctgtggagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagtagcagtggcaggcggtatggacgtctggggccaagggaccacggtcaccgtctcctca

SEQ ID NO: 28410 - protein, 118 aa, Artificial Sequence
  Description of Artificial Sequence: Synthetic polypeptide
QVQLVESGGGVVQPGRSLRLSCGASGFTFSSYGMHWVRQAPGKGLEWVAVIWYDGSNKYYADSVKGRFTISRDNSKNTLYLQMNSLRAEDTAVYYCARVAVAGGMDVWGQGTTVTVSS

SEQ ID NO: 28411 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagaagctatgccatgagctggatccgccaggctccagggagggggctggagtggtcttcagttattagtggtagtggtggtagcacatattacgcagactccgtgaagggccggttcaccatctccagagacaattccaagaacacgctgtatctgcaaatgagcagcctgagagccgaagacacggccgtatattactgtgcgaaaaggtataacagtggctggcatgatgtttttgatatctggggccaagggacaatggtcaccgtctcttca

SEQ ID NO: 28412 - protein, 121 aa, Artificial Sequence
  Description of Artificial Sequence: Synthetic polypeptide
EVQLLESGGGLVQPGGSLRLSCAASGFTFRSYAMSWIRQAPGRGLEWSSVISGSGGSTYYADSVKGRFTISRDNSKNTLYLQMSSLRAEDTAVYYCAKRYNSGWHDVFDIWGQGTMVTVSS

SEQ ID NO: 28413 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaaataataaatactatgtagactccgtgaagggccgattcaccatctccagagacaactccaagaacacgctgtatctgcaaatgaacagcctgagagccgaggacacggctgtgtattactgtgcgagagagttggggttccggtctgactactggggccagggaaccctggtcaccgtctcctca

SEQ ID NO: 28414 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDENNKYYVDSVKGRFTISRDNSKNTLYLQMNSLRAEDTAVYYCARELGFRSDYWGQGTLVTVSS

SEQ ID NO: 28415 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgaactgggtccgccaggctccagggaaggggctggagtgggtctcagttattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtttggcagtggctggctcggaggcttgtgatatctggggccaagggacaatggtcaccgtctcttca

SEQ ID NO: 28416 - protein, 121 aa, Artificial Sequence
  Description of Artificial Sequence: Synthetic polypeptide
EVQLLESGGGLVQPGGSLRLSCAASEFTFSSYAMNWVRQAPGKGLEWVSVISGRGGNTFYADSVKGRFTISRDNSKNTLYLQMNSLRAEDTAVYYCASRLAVAGSEACDIWGQGTMVTVSS

SEQ ID NO: 28417 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatgtggtatgatggaagtaataaatattatgcagactccgtgaagggccgattcaccatctccagagacaattccaagaacacgctgtatctgcaaatgaacagcctgagagccgaggacacggctgtgtattactgtgcgagagatgggggatttttggagtggttagactactggggccagggaaccctggtcaccgtctcctca

SEQ ID NO: 28418 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVMWYDGSNKYYADSVKGRFTISRDNSKNTLYLQMNSLRAEDTAVYYCARDGGFLEWLDYWGQGTLVTVSS

SEQ ID NO: 28419 - DNA, 363 bp, Artificial Sequence
  Description of Artificial Sequence: Synthetic polynucleotide
gaggtgcagctgttggagtctgggggaggcttggtgcagcctggggggtccctgagactctcctgtgcagcctctgaattcacctttagcagctatgccatgagctgggtccgccaggctccagggaaggggctggagtgggtctcaattattagtggtcgtggtactaacacattctacgcagactccgtgaagggccggttcaccatctccagagtcaattccaagaacacgctgtatctgcaaatgaacagcctgagagccgaggacacggccgtatattactgtgcgtcccgtatagcagtggctggctcggaggcttttgatatctggggccaagggacaatggtcaccgtctcttca

SEQ ID NO: 28420 - protein, 121 aa, Artificial Sequence
  Description of Artificial Sequence: Synthetic polypeptide
EVQLLESGGGLVQPGGSLRLSCAASEFTFSSYAMSWVRQAPGKGLEWVSIISGRGTNTFYADSVKGRFTISRVNSKNTLYLQMNSLRAEDTAVYYCASRIAVAGSEAFDIWGQGTMVTVSS

SEQ ID NO: 28421 - DNA, 348 bp, Artificial Sequence
  Description of Artificial Sequence: Synthetic polynucleotide
caggtgcagctggtggagtctgggggaggcgtggtccagcctgggaggtccctgagactctcctgtgtagcctctggattcaccttcaggagctatggcatgcactgggtccgccaggctccaggcaaggggctggagtgggtgacaattatatcatatgatggaagtaataaatactatgcagactccgtgaagggccgattcaccatctccagagacaattccaagaacacgctgtatctgcaaatgaacagcctgagagctgaggacacggctgtatatttctgtgcgagaggggtttggttcggggacttctggggccagggaaccctggtcaccgtctcctca

SEQ ID NO: 28422 - protein, 116 aa, Artificial Sequence
  Description of Artificial Sequence: Synthetic polypeptide
QVQLVESGGGVVQPGRSLRLSCVASGFTFRSYGMHWVRQAPGKGLEWVTIISYDGSNKYYADSVKGRFTISRDNSKNTLYLQMNSLRAEDTAVYFCARGVWFGDFWGQGTLVTVSS

SEQ ID NO: 28423 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaagggactggagtggattgggagtatctattatagtgggagcgcccagtacaacccgtccctcaagagtcgagtcaccatatccgtcgacacgtccaagaaccagttctccctgacgctgagctctgtgaccgccgcagacacggctttatattactgtgcgagactgagcagcagctggtcttttgactactggggccagggaaccctggtcaccgtctcctca

SEQ ID NO: 28424 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGSIYYSGSAQYNPSLKSRVTISVDTSKNQFSLTLSSVTAADTALYYCARLSSSWSFDYWGQGTLVTVSS

SEQ ID NO: 28425 - DNA, 357 bp, Artificial Sequence
  Description of Artificial Sequence: Synthetic polynucleotide
cagttgcaactgcaggagtcgggcccaggactggtgaagccttcggagaccctgtccctcacctgcactgtctctggtggctccatcagtaggagtagttactactggggctggatccgccagcccccagggaaggggctggagtggattgggaatatttattatagtgggaccacttacaacaacccgtccctcaagagtcgagtcaccatatccgtagacacgtccaagaaccacttctccctgaagctgagctctgtgaccgccgcagacacggctgtgtattactgtgggagacatggaaaagactggggccttgactactggggccagggaaccctggtcaccgtctcctca

SEQ ID NO: 28426 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGTTYNNPSLKSRVTISVDTSKNHFSLKLSSVTAADTAVYYCGRHGKDWGLDYWGQGTLVTVSS

SEQ ID NO: 28427 - DNA, 357 bp, Artificial Sequence
  Description of Artificial Sequence: Synthetic polynucleotide
cagctgcagctgcaggagtcgggcccaggactggtgaagccctcggagaccctgtccctcacctgcactgtctctggtggcgccatcagcaggagtagttactactggggctggatccgccagcccccagggaaggggctggagtggattgggagtatctattatagtgggagcgccaactacaacccgtccctcaagagtcgagtcaccatatccgtagacacgtccaagaaccagttctccctgaagctgagctctgtgaccgccgcagacacggctgtgtattactgtgcgagactcagcagcagctggtccattgacaactggggccagggaaccctggtcaccgtctcctca

SEQ ID NO: 28428 - protein, 119 aa, Artificial Sequence
  Description of Artificial Sequence: Synthetic polypeptide
QLQLQESGPGLVKPSETLSLTCTVSGGAISRSSYYWGWIRQPPGKGLEWIGSIYYSGSANYNPSLKSRVTISVDTSKNQFSLKLSSVTAADTAVYYCARLSSSWSIDNWGQGTLVTVSS

SEQ ID NO: 28429 - DNA, 351 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactatgcagactctgtgaagggccgattcaccatctccagagacaatgccaagaactcactgtacctgcaaatgaacagcctgagagacgaggacacggctgtgtattactgtgcgaggtcactatggtccccctttgactactggggccagggaaccctggtcaccgtctcctca

SEQ ID NO: 28430 - protein, 117 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARSLWSPFDYWGQGTLVTVSS

SEQ ID NO: 28431 - DNA, 351 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttacttctggagctggatccggcagcccgccgggaagggactggagtggattgggcgtatctataccagtgggatcaccaactacaacccctccctcaagagtcgagtcaccatgtcagtagacacgtccaagaaccagttctccctgaaactgagttctgtgaccgccgcggacacggccatatattactgtgcgagaggcccgacttcggggtggttcgacccctggggccagggaaccctggtcaccgtctcctca

SEQ ID NO: 28432 - protein, 117 aa, Artificial Sequence
  Description of Artificial Sequence: Synthetic polypeptide
QVQLQESGPGLVKPSETLSLTCTVSGGSISSYFWSWIRQPAGKGLEWIGRIYTSGITNYNPSLKSRVTMSVDTSKNQFSLKLSSVTAADTAIYYCARGPTSGWFDPWGQGTLVTVSS

SEQ ID NO: 28433 - DNA, 351 bp, Artificial Sequence
  Description of Artificial Sequence: Synthetic polynucleotide
caggtgcagctggtggagtctgggggaggcgtggtccagtctgggaggtccctgagactctcctgtgcagcgtctggattcaccttcagtgactatggcatgcactgggtccgccaggctccaggcaaggggctggagtgggtggcagttatatggtttgatggaagtaataaatactatgcagactccgtgaagggccgattcaccatctccagagacaattccaagaacacgctgtatctgcaaatgaacagcctgagagccgaggacacggctgtgtattactgtgcgagagatcttggctggacggaagagtactggggccagggaaccctggtcaccgtctcctca

SEQ ID NO: 28434 - protein, 117 aa, Artificial Sequence
  Description of Artificial Sequence: Synthetic polypeptide
QVQLVESGGGVVQSGRSLRLSCAASGFTFSDYGMHWVRQAPGKGLEWVAVIWFDGSNKYYADSVKGRFTISRDNSKNTLYLQMNSLRAEDTAVYYCARDLGWTEEYWGQGTLVTVSS

SEQ ID NO: 28435 - DNA, 357 bp, Artificial Sequence
  Description of Artificial Sequence: Synthetic polynucleotide
caactgcagctgcaggagtcgggcccaggactggtgaagccttcggagaccctgtccctcacctgtactgtttctggtggctccatcaacaggagtagttactactggggctggatccgccagcccccagggaaggggctggagtggattgggaatatctattatagtggggccacctattataattcgtccctcaagagtcgagtcaccatctccgtagacacgtccacgaaccagttctccctgaagctgagctctgtgaccgccgcagacacggctgtgtattactgtgcgagacatagcggcagctggtcccttgactactggggccagggaaccctggtcaccgtctcctca

SEQ ID NO: 28436 - protein, 119 aa, Artificial Sequence
  Description of Artificial Sequence: Synthetic polypeptide
QLQLQESGPGLVKPSETLSLTCTVSGGSINRSSYYWGWIRQPPGKGLEWIGNIYYSGATYYNSSLKSRVTISVDTSTNQFSLKLSSVTAADTAVYYCARHSGSWSLDYWGQGTLVTVSS

SEQ ID NO: 28437 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagcgactatggcatgcactgggtccgccaggctccaggcaaggggctggagtgggtggcagttatatggtatgatggaagtaataaatactatgtagactccgtgaagggccgattcaccatctccagagacaattccaagaacacgctgtatctgcaaatgaacagcctgagagccgaggacacggctgtgtattactgtgcgagagaaaagtatagcagcagctggtacgactacggtatggacgtctggggccaagggaccacggtcaccgtctcctca

SEQ ID NO: 28438 - protein, 123 aa, Artificial Sequence
  Description of Artificial Sequence: Synthetic polypeptide
QVQLVESGGGVVQPGRSLRLSCAASGFTFSDYGMHWVRQAPGKGLEWVAVIWYDGSNKYYVDSVKGRFTISRDNSKNTLYLQMNSLRAEDTAVYYCAREKYSSSWYDYGMDVWGQGTTVTVSS

SEQ ID NO: 28439 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcaacaggagtagttactactggggctggatccgccagcccccagggaaggggctggactggattgggaatatctattatagtgggagcacctactacaacccgtccgtcaagagtcgattcaccatatccgtagacacgtccaagaaccagttctccctgaagctgagctctgtgaccgccgcagacacggctgtgtattactgtgcgagacatggaaaagactggggccttgactactggggccagggaaccctggtcaccgtctcctca

SEQ ID NO: 28440 - protein, 119 aa, Artificial Sequence
  Description of Artificial Sequence: Synthetic polypeptide
QLQLQESGPGLVKPSETLSLTCTVSGGSINRSSYYWGWIRQPPGKGLDWIGNIYYSGSTYYNPSVKSRFTISVDTSKNQFSLKLSSVTAADTAVYYCARHGKDWGLDYWGQGTLVTVSS

SEQ ID NO: 28441 - DNA, 345 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggagggggctggagtgggtctcagttattagtggtagtggtggtaccacatataacacagactccgtgaagggccggttcaccatctccagagacaattccaagaacacgctatatctgcaaatgaacagcctgagagccgaggacacggccgtatattactgtgcccgcagctccttgtttgactactggggccagggaaccctggtcaccgtctcctca

SEQ ID NO: 28442 - protein, 115 aa, Artificial Sequence
  Description of Artificial Sequence: Synthetic polypeptide
EVQLLESGGGLVQPGGSLRLSCAASGFTFSSYAMSWVRQAPGRGLEWVSVISGSGGTTYNTDSVKGRFTISRDNSKNTLYLQMNSLRAEDTAVYYCARSSLFDYWGQGTLVTVSS

SEQ ID NO: 28443 - DNA, 345 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcggttagcagtggctggttcgcctggggccagggaaccctggtcaccgtctcctca

SEQ ID NO: 28444 - protein, 115 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAVSSGWFAWGQGTLVTVSS

SEQ ID NO: 28445 - DNA, 342 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagttcctataccatgaactgggtccgccaggctccagggaaggggctggagtgggtctcatccattagtggtagtagtagttacatatggtatgtagactcagtgaagggccgattcaccatctccagagacaacgccaagaactcactgtatctgcaaatgaacagcctgagagccgaggacacggctgtgtattactgtgcgagagatcggggcagtctctggggccagggaaccctggtcaccgtctcctca

SEQ ID NO: 28446 - protein, 114 aa, Artificial Sequence
  Description of Artificial Sequence: Synthetic polypeptide
EVQLVESGGGLVKPGGSLRLSCAASGFTFSSYTMNWVRQAPGKGLEWVSSISGSSSYIWYVDSVKGRFTISRDNAKNSLYLQMNSLRAEDTAVYYCARDRGSLWGQGTLVTVSS

SEQ ID NO: 28447 - DNA, 369 bp, Artificial Sequence
  Description of Artificial Sequence: Synthetic polynucleotide
caggtgcagctggtggagtctgggggaggcgtggtccagcctgggaggtccccgagactctcctgtgcagcgtctggattcatcttcagtaactatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggaatatagtagtggctggtacgactacggtatggacgtctggggccaagggaccacggtcaccgtctcctca

SEQ ID NO: 28448 - protein, 123 aa, Artificial Sequence
  Description of Artificial Sequence: Synthetic polypeptide
QVQLVESGGGVVQPGRSPRLSCAASGFIFSNYVMHWVRQAPGKGLEWVAVIWYDGSNKYYADSVKGRFTISRDNSKNTLYLQMNSLRAEDTAVYYCAREEYSSGWYDYGMDVWGQGTTVTVSS

SEQ ID NO: 28449 - DNA, 342 bp, Artificial Sequence
  Description of Artificial Sequence: Synthetic polynucleotide
gaagtgcagctggtggaatctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattattgtgcgagagatcgtgggagctgctggggccagggaaccctggtcaccatctcctca

SEQ ID NO: 28450 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGSCWGQGTLVTISS

SEQ ID NO: 28451 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtacctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctatttattactgtgcgagagatcgtgggagcctctggggccagggaaccctggtcaccgtctcctca

SEQ ID NO: 28452 - protein, 114 aa, Artificial Sequence
  Description of Artificial Sequence: Synthetic polypeptide
EVQLVESGGGLVKPGGSLRLSCAASGFTFSTYSMNWVRQAPGKGLEWVSSISSSSSYIYYADSVKGRFTISRDNAKNSLYLQMNSLRAEDTAIYYCARDRGSLWGQGTLVTVSS

SEQ ID NO: 28453 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctaaattcacctttagcagctatgccatgaactgggtccgccaggctccagggaaggggctggagtggatctcaattattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtttggcagtggctggctcggaggcttttgatatctggggccaagggacaatggtcaccgtctcttca

SEQ ID NO: 28454 - protein, 121 aa, Artificial Sequence
  Description of Artificial Sequence: Synthetic polypeptide
EVQLLESGGGLVQPGGSLRLSCAASKFTFSSYAMNWVRQAPGKGLEWISIISGRGGNTFYADSVKGRFTISRDNSKNTLYLQMNSLRAEDTAVYYCASRLAVAGSEAFDIWGQGTMVTVSS

SEQ ID NO: 28455 - DNA, 351 bp, Artificial Sequence
  Description of Artificial Sequence: Synthetic polynucleotide
caggtgcagctggtggagtctgggggaggcgtggtccagcctgggaggtccctgagactctcctgttcagcgtctggattcaccttcagtgactatggcatgcactgggtccgccaggctccaggcaaggggctggagtgggtggcagttatatggtatgatgaaagtaataaatactatgcagactccgtgaagggccgattcaccatctccagagacaattccaagaacacgctgtatctgcaaatgaacagcctgagagccgaggacacggctatgtattactgtacgagagaactggggttccggtctgactattggggccagggaaccctggtcaccgtctcctca

SEQ ID NO: 28456 - protein, 117 aa, Artificial Sequence
  Description of Artificial Sequence: Synthetic polypeptide
QVQLVESGGGVVQPGRSLRLSCSASGFTFSDYGMHWVRQAPGKGLEWVAVIWYDESNKYYADSVKGRFTISRDNSKNTLYLQMNSLRAEDTAMYYCTRELGFRSDYWGQGTLVTVSS

SEQ ID NO: 28457 - DNA, 345 bp, Artificial Sequence
  Description of Artificial Sequence: Synthetic polynucleotide
gaggtgcagctgttggagtctgggggaggcttggtccaacctggggggtccctgagactctcctgtgcagcctctggattcacctttagcagctatgccatgagctgggtccgccaggctccagggaaggggctggagtgggtctcaggtattagtggtagtggaggtaacacaccctacgcagactccgtgaagggccggttcaccatctccagagacatttccaagaacacgctgtatctgcaaatgaacagcctgagagccgaagacacggccgtatattactgtgcgaaagtagtgggagctgtccactggggccggggaaccctggtcaccgtctcctca

SEQ ID NO: 28458 - protein, 115 aa, Artificial Sequence
  Description of Artificial Sequence: Synthetic polypeptide
EVQLLESGGGLVQPGGSLRLSCAASGFTFSSYAMSWVRQAPGKGLEWVSGISGSGGNTPYADSVKGRFTISRDISKNTLYLQMNSLRAEDTAVYYCAKVVGAVHWGRGTLVTVSS

SEQ ID NO: 28459 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttactactggggctggatccgccagcccccagggaaggggctggagtggattgggaatatttattatagtgggagcacctaccacaacccgtctctcaagagtcgagtcaccatatccgtagacacgtccatgaaccagttctccctgaagttgacctctgtgaccgccgcagacacggctgtgtatttctgtgggagacatggaaaagactggggccttgactactggggccagggaaccctggtcaccgtctcctca

SEQ ID NO: 28460 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYHNPSLKSRVTISVDTSMNQFSLKLTSVTAADTAVYFCGRHGKDWGLDYWGQGTLVTVSS

SEQ ID NO: 28461 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatctggtatgatggaaataataaatactatgcagactccgtgaagggccgattcaccatctccagagacaattccaagaacacgctgtatctgcaaatgaacagcctgagagccgaggacacggctgtgtattactgtgcgagagagcttgcctggtacgaagactactggggccagggaaccctggtcaccgtctcctca

SEQ ID NO: 28462 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGNNKYYADSVKGRFTISRDNSKNTLYLQMNSLRAEDTAVYYCARELAWYEDYWGQGTLVTVSS

SEQ ID NO: 28463 - DNA, 366 bp, Artificial Sequence
  Description of Artificial Sequence: Synthetic polynucleotide
caggtgcagctgcaggcgtcgggcccaggactggtgaagccttcacagaccctgtccctcacctgcactgtctctgatggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagttctgtgactgccgcggacacggccgtatattactgtgcgagagaggacggtgccttcggctactacggtatggacgtctggggccaagggaccacggtcaccgtctcctca

SEQ ID NO: 28464 - protein, 122 aa, Artificial Sequence
  Description of Artificial Sequence: Synthetic polypeptide
QVQLQASGPGLVKPSQTLSLTCTVSDGSISSGGYYWSWIRQHPGKGLEWIGYIYYSGSTYYNPSLKSRVTISVDTSKNQFSLKLSSVTAADTAVYYCAREDGAFGYYGMDVWGQGTTVTVSS

SEQ ID NO: 28465 - DNA, 351 bp, Artificial Sequence
  Description of Artificial Sequence: Synthetic polynucleotide
caggagcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaaataataaatactatgtagactccgtgaagggccgattcaccatctccagagacaactccaagaacacgctgtatctgcaaatgaacagcctgagagccgaggacacggctgtgtattactgtgcgagagaattggggttccggtctgactactggggccagggaaccctggtcaccgtctcctca

SEQ ID NO: 28466 - protein, 117 aa, Artificial Sequence
  Description of Artificial Sequence: Synthetic polypeptide
QEQLVESGGGVVQPGRSLRLSCAASGFTFSSYGMHWVRQAPGKGLEWVAVIWYDENNKYYVDSVKGRFTISRDNSKNTLYLQMNSLRAEDTAVYYCARELGFRSDYWGQGTLVTVSS

SEQ ID NO: 28467 - DNA, 363 bp, Artificial Sequence
  Description of Artificial Sequence: Synthetic polynucleotide
caggtgcaactggtagagtctgggggaggcgtggtccagcctgggaggtccctgagactctcctgtgcagcctctggattcaccttcagtagctatggcatgcactgggtccgccaggttccaggcaaggggctggagtgggtggcaattatatcatatgctggaagtaataaatcctatgcagactccgtgaagggccgattcaccatctccagagacaattccaagaacacgctgtatctgcaaatgaacagcctgagagctgaggacacggctgtgtattactgtgtgagacggggatacagctatggcgggtacggtatggacgtctggggccaaggggccacggtcaccgtctcctca

SEQ ID NO: 28468 - protein, 121 aa, Artificial Sequence
  Description of Artificial Sequence: Synthetic polypeptide
QVQLVESGGGVVQPGRSLRLSCAASGFTFSSYGMHWVRQVPGKGLEWVAIISYAGSNKSYADSVKGRFTISRDNSKNTLYLQMNSLRAEDTAVYYCVRRGYSYGGYGMDVWGQGATVTVSS

SEQ ID NO: 28469 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcaggagtagttactactggggctggatccgccagcccccagggaagggactggagtggattgggagtatctattatagtgggagcgcctcttacaacccgtccctcaagagtcgagtcaccatatccgtagacacgtccaggaaccagttctccctgaagctgagctctgtgaccgccgcagacacggctgcgtattactgtgcgagactgagcagcagctggtcttttgactactggggccagggaaccctggtcaccgtctcctca

SEQ ID NO: 28470 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGSIYYSGSASYNPSLKSRVTISVDTSRNQFSLKLSSVTAADTAAYYCARLSSSWSFDYWGQGTLVTVSS

SEQ ID NO: 28471 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaaggtccgattcaccgtctccagagacaattccaagaacacgctgtctctgcaaatgaacagcctgagagccgaggacacggctgtgtattactgtgcgagagagagatataccagtggctggtatgactacggtatggacgtctggggccaagggaccacggtcaccgtctcctca

SEQ ID NO: 28472 - protein, 123 aa, Artificial Sequence; identical to SEQ ID NO: 28208
  Description of Artificial Sequence: Synthetic polypeptide

SEQ ID NO: 28473 - DNA, 369 bp, Artificial Sequence
  Description of Artificial Sequence: Synthetic polynucleotide
gaggtgaagctgttggagtctgggggaggcttggtacagccgggggggtccctgagactctcctgtgcagcctctggattcacctttaacaactatgccatgagctgggtccgccaggctccagggaaggggctggagtgggtctcagttcttagtggtagtggtggtagcacattctacgcagactccgtgaagggccggttcaccatctccagagacaattccaagaacacgctgtatctgcaaatgagcagcctgagagccggggacacggccgtatatttctgtgcccgatattgtagtagtgccaggtgcccttatgatgcctttgatatctggggccaagggacaatggtcaccgtctcctca

SEQ ID NO: 28474 - protein, 123 aa, Artificial Sequence
  Description of Artificial Sequence: Synthetic polypeptide
EVKLLESGGGLVQPGGSLRLSCAASGFTFNNYAMSWVRQAPGKGLEWVSVLSGSGGSTFYADSVKGRFTISRDNSKNTLYLQMSSLRAGDTAVYFCARYCSSARCPYDAFDIWGQGTMVTVSS

SEQ ID NO: 28475 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtttgatggaaataataaatactatgtagactccgtgaagggccgattcaccatctccagagacaattccaagaacacgctgtatctgcaaatgaacagcctgagagccgaggacacggctgtgtattactgtgcgagagatcttggctggacggaagagtactggggccagggaaccctggtcaccgtctcctca

SEQ ID NO: 28476 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFDGNNKYYVDSVKGRFTISRDNSKNTLYLQMNSLRAEDTAVYYCARDLGWTEEYWGQGTLVTVSS

SEQ ID NO: 28477 - DNA, 363 bp, Artificial Sequence
  Description of Artificial Sequence: Synthetic polynucleotide
gaggtgcagctgttggagtctgggggaggcttggtacaggttggggggtccctgagactctcctgtgcagcctctggattcacttttagcagctatgccatgagctgggtccgccaggctccagggatggggctggagtgggtctcaattattagtggtagtggtggttacacatactacgcggactccgtgaagggccgattcaccatctccagagacaattccaagaacacgctgtatctgcaaatgaacagcctgagagccgaggacacggccgtatattattgtgcgtcccgtatagcagtggctggctcggaggcttttgatatctggggccaagggacaatggtcaccgtctcttca

SEQ ID NO: 28478 - protein, 121 aa, Artificial Sequence
  Description of Artificial Sequence: Synthetic polypeptide
EVQLLESGGGLVQVGGSLRLSCAASGFTFSSYAMSWVRQAPGMGLEWVSIISGSGGYTYYADSVKGRFTISRDNSKNTLYLQMNSLRAEDTAVYYCASRIAVAGSEAFDIWGQGTMVTVSS

SEQ ID NO: 28479 - DNA, 351 bp, Artificial Sequence
  Description of Artificial Sequence: Synthetic polynucleotide
caggtgcagatggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaggaaaataataaagactatgtagactccgtgaagggccgattcaccatctccagagacaattccaagagcacgctgtatctgcaaatgaatagtctgagagccgaggacacggctgtgtattactgtgtgagagagttaggcttccagtctgactactggggccagggaaccccggtcaccgtctcctca

SEQ ID NO: 28480 - protein, 117 aa, Artificial Sequence
  Description of Artificial Sequence: Synthetic polypeptide
QVQMVESGGGVVQPGRSLRLSCAASGFTFSSYGMHWVRQAPGKGLEWVAVIWYEENNKDYVDSVKGRFTISRDNSKSTLYLQMNSLRAEDTAVYYCVRELGFQSDYWGQGTPVTVSS

SEQ ID NO: 28481 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttactactggggctggatccgccagcccccagggcaggggctggagtggattgggaatatttattatagtgggagcacctacaacaacccgtccctcaagagtcgagtctccatatccgttgacacgtccaagaaccagttctccctgaacctgagctctgtgaccgccgcagacacggctgtgtattactgtgggagacatggaaaagactggggccttgacttctggggccagggaaccctggtcaccgtctcctca

SEQ ID NO: 28482 - protein, 119 aa, Artificial Sequence
  Description of Artificial Sequence: Synthetic polypeptide
QLQLQESGPGLVKPSETLSLTCTVSGGSISRSSYYWGWIRQPPGQGLEWIGNIYYSGSTYNNPSLKSRVSISVDTSKNQFSLNLSSVTAADTAVYYCGRHGKDWGLDFWGQGTLVTVSS

SEQ ID NO: 28483 - DNA, 369 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaaggtatagcagtggctggcacgactacggtatggacgtctggggccaagggaccacggtcaccgtctcctca

SEQ ID NO: 28484 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARERYSSGWHDYGMDVWGQGTTVTVSS

SEQ ID NO: 28485 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggataccccttcaccaattatgatatcaactgggtgcgacaggccactggacaagggcttgagtggatgggatggatgcaccctaacagtggtaacacaggctatgcacagaagttccagggcagagtcaccatgaccaggaacacctccataaacacagcctacatggaactgagcagcctgagatctgaggacacggccgtgtattactgtgcgggtagcagtggctggtactactttgactactggggccagggaaccctggtcaccgtctcctca

SEQ ID NO: 28486 - protein, 118 aa, Artificial Sequence
  Description of Artificial Sequence: Synthetic polypeptide
QVQLVQSGAEVKKPGASVKVSCKASGYPFTNYDINWVRQATGQGLEWMGWMHPNSGNTGYAQKFQGRVTMTRNTSINTAYMELSSLRSEDTAVYYCAGSSGWYYFDYWGQGTLVTVSS

SEQ ID NO: 28487 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagcagctggtcagggggtatggacgtctggggccaagggaccacggtcaccgtctcctca

SEQ ID NO: 28488 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRYSSSWSGGMDVWGQGTTVTVSS

SEQ ID NO: 28489 - DNA, 345 bp, Artificial Sequence
  Description of Artificial Sequence: Synthetic polynucleotide
gaggtgcagctgttggagtctgggggaggcttggtacagcctggggggtccctgagactctcctgtgcagcctccggattcacctttagcagctatgccatgagctgggtccgccaggctccagggaaggggctggagtgggtctcagctattagtggtagtggtggttacacatactacgcagactccgtgaagggccggttcaccatctccagagacaattccgagaacacgctgtatctgcaaatgagcagcctgagagccgaggacacggccgtttattactgtgcgaaaggggggtccctcttctactggggccagggaaccctggtcaccgtctcctca

SEQ ID NO: 28490 - protein, 115 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGYTYYADSVKGRFTISRDNSENTLYLQMSSLRAEDTAVYYCAKGGSLFYWGQGTLVTVSS

SEQ ID NO: 28491 - DNA, 336 bp, Artificial Sequence
  Description of Artificial Sequence: Synthetic polynucleotide
gaggtgcagctgttggagtcggggggaggcttggtacagcctggggggtccctgagactctcctgtgcagcctctggattctcctttagtagctatgccatgagctgggtccgccaggctccagggaaggggctggagtgggtctcaactattagtggtcgtggtggtcacacatactacgcagactccgtgaagggccggttcgccatctccagagacagttccaagaacacgctgtatctgcaaatgaacagcctgagagccgaggacacggccgtatattactgtgcgaaacaggactgctggggccagggaaccctggtcaccgtctcctca

SEQ ID NO: 28492 - protein, 112 aa, Artificial Sequence
  Description of Artificial Sequence: Synthetic polypeptide
EVQLLESGGGLVQPGGSLRLSCAASGFSFSSYAMSWVRQAPGKGLEWVSTISGRGGHTYYADSVKGRFAISRDSSKNTLYLQMNSLRAEDTAVYYCAKQDCWGQGTLVTVSS

SEQ ID NO: 28493 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtgactatggcatgcactgggtccgccaggctccaggcaaggggctggagtggatggcagttatatggtatgatgtaactaataaatactatgcagactccgtgaagggccgattcaccatctccagagacaattccaagaacacgctgtatctggaaatgaacagcctgagagccgaggacacggctgtttattactgtgcgagagagcttggctggtacgaggactactggggccagggaaccctggtcaccgtctcctca

SEQ ID NO: 28494 - protein, 117 aa, Artificial Sequence
  Description of Artificial Sequence: Synthetic polypeptide
QVQLVESGGGVVQPGRSLRLSCAASGFTFSDYGMHWVRQAPGKGLEWMAVIWYDVTNKYYADSVKGRFTISRDNSKNTLYLEMNSLRAEDTAVYYCARELGWYEDYWGQGTLVTVSS

SEQ ID NO: 28495 - DNA, 357 bp, Artificial Sequence
  Description of Artificial Sequence: Synthetic polynucleotide
cagctgcagctgcaggagtcgggcccaggactggtgaagttttcggagaccctgtccctcacctgcactgtctctggtggctccatcagcagaagtagttactactggggctggatccgccagcccccagggaaggggcaggagtggatagggaatatctattatagtgggtatagttactacaatccgtccctcaagagtcgagtcaccatatccgtagacacgtccaagaaccagttctccctgaagctgagctctgtgaccgccgcagacacggctgtgtattactgtgcgagacatagcaccagctggtcccttgactactggggccagggaaccctggtcaccgtctcctca

SEQ ID NO: 28496 - protein, 119 aa, Artificial Sequence
  Description of Artificial Sequence: Synthetic polypeptide
QLQLQESGPGLVKFSETLSLTCTVSGGSISRSSYYWGWIRQPPGKGQEWIGNIYYSGYSYYNPSLKSRVTISVDTSKNQFSLKLSSVTAADTAVYYCARHSTSWSLDYWGQGTLVTVSS

SEQ ID NO: 28497 - DNA, 354 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaaggctggaacacggactactggggccagggaaccctggtcaccgtctcctca

SEQ ID NO: 28498 - protein, 118 aa, Artificial Sequence
  Description of Artificial Sequence: Synthetic polypeptide
EVQLVESGGGLVKPGGSLRLSCAASGFTFSNAWMNWVRQAPGKGLEWVGRIKSKTDGGTTDYAAPVKGRFTISRDDSKNTLYLQMNSLKTEDTAVYYCTTEGWNTDYWGQGTLVTVSS

SEQ ID NO: 28499 - DNA, 351 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgagggaagtaataaatactatgtagactccgtgaggggccgattcaccatctccagagacaattccaagagcacgctgtatctgcaaatgaacagcctgagagccgaggacacggctgtttattactgtgtgagagagctaggcttccagtctgactactggggccagggaaccccggtcaccgtctcctca

SEQ ID NO: 28500 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYEGSNKYYVDSVRGRFTISRDNSKSTLYLQMNSLRAEDTAVYYCVRELGFQSDYWGQGTPVTVSS

SEQ ID NO: 28501 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgagctgggtccgccaggctccagggaaggggctggagtgggtctcagttattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtatagcagtggctggctcggaggcttttgatatctggggccaagggacaatggtcaccgtctcttca

SEQ ID NO: 28502 - protein, 121 aa, Artificial Sequence
  Description of Artificial Sequence: Synthetic polypeptide
EVQLLESGGGLVQPGGSLRLSCAASEFTFSSYAMSWVRQAPGKGLEWVSVISGRGGNTFYADSVKGRFTISRDNSKNTLYLQMNSLRAEDTAVYYCASRIAVAGSEAFDIWGQGTMVTVSS

SEQ ID NO: 28503 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctccggtggcgccatcagcggtagtaattactactggggctggatccgccagcccccagggaaggaactggagtggattggaaatatctattatagtgggagcacctactacaacccgtccctcaagagtcgagtcaccatatccgtagacacgtccaagaaccagttctccctgaagctgaggtctgtgaccgccgaagacacggctgtgtattactgtgcgagacatagcagtagctggtcccttgactactggggccagggaaccctggtcaccgtctcctca

SEQ ID NO: 28504 - protein, 119 aa, Artificial Sequence
  Description of Artificial Sequence: Synthetic polypeptide
QLQLQESGPGLVKPSETLSLTCTVSGGAISGSNYYWGWIRQPPGKELEWIGNIYYSGSTYYNPSLKSRVTISVDTSKNQFSLKLRSVTAEDTAVYYCARHSSSWSLDYWGQGTLVTVSS

SEQ ID NO: 28505 - DNA, 351 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagctatggcatgcactgggtccgccaggctccaggcaaggggctggagtgggtggcagttatatggtatgatgaaactaataaatactatgcagactccgtgaagggccgattcaccatctccagagacaattccaagaacacgctgtatctgcaaatgaacagcctgagagccgaggacacggctatttattactgtgcgagagagcttgcctggtacgaggactactggggccagggatccctggtcaccgtctcctca

SEQ ID NO: 28506 - protein, 117 aa, Artificial Sequence
  Description of Artificial Sequence: Synthetic polypeptide
QVQLVESGGGVVQPGRSLRLSCVASGFTFSSYGMHWVRQAPGKGLEWVAVIWYDETNKYYADSVKGRFTISRDNSKNTLYLQMNSLRAEDTAIYYCARELAWYEDYWGQGSLVTVSS

SEQ ID NO: 28507 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgtaactaataaatactatacaggctccgtgaagggccgattcaccatctccagagacaattccaagaacacgctgtatctgcaaatgaacagcctgagagccgaggacacggctgtatattactgtgcgagagaaattggctggttagatgactactggggccagggaaccctggtcaccgtctcctca

SEQ ID NO: 28508 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDVTNKYYTGSVKGRFTISRDNSKNTLYLQMNSLRAEDTAVYYCAREIGWLDDYWGQGTLVTVSS

SEQ ID NO: 28509 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagcgatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtatagcagcagctggtacgactacggtatggacgtctggggccaagggaccacggtcaccgtctcctca

SEQ ID NO: 28510 - protein, 123 aa, Artificial Sequence
  Description of Artificial Sequence: Synthetic polypeptide
QVQLVESGGGVVQPGRSLRLSCAASGFTFSSDGMHWVRQAPGKGLEWVAVIWYDGSNKYYADSVKGRFTISRDNSKNTLYLQMNSLRAEDTAVYYCARERYSSSWYDYGMDVWGQGTTVTVSS

SEQ ID NO: 28511 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccactagtagtagtgatagttatatatactacgcagactcagtgaagggccgattcaccatctccagagacaacgccaagaactcactgtatctgcaaatgaacagcctgagagccgaggacacggctgtgtattactgtgcgagagtggcgtcctttgactgctggggccagggaaccctggtcaccgtctcctca

SEQ ID NO: 28512 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSTSSSDSYIYYADSVKGRFTISRDNAKNSLYLQMNSLRAEDTAVYYCARVASFDCWGQGTLVTVSS

SEQ ID NO: 28513 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaaataataaatactatgcagactccgtgaagggccgattcaccatctccagagacaattccaagaacacgctgtatctgcaaatgaacagcctgagagccgaggacacggctgtgtattactgtgcgagagaattaggctggtacgacgactactggggccagggaaccctggtcaccgtctcctca

SEQ ID NO: 28514 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDENNKYYADSVKGRFTISRDNSKNTLYLQMNSLRAEDTAVYYCARELGWYDDYWGQGTLVTVSS

SEQ ID NO: 28515 - DNA, 351 bp, Artificial Sequence
  Description of Artificial Sequence: Synthetic polynucleotide
caggtgcagctggtggagtctgggggaggcgtggtccagcctgggaggtccctgagactcacctgtgcagcgtctggattcaccttcagtgactatggcatacactgggtccgccaggctccaggcaaggggctggagtgggtggcagttatatggtatgatgaaagtaataaatactatgcagactccatgaagggccgattcaccatctccagagacaattccaagaacacgctgtatctgcaaatgaacagcctgagagccgaggacacggctgtgtattactgtgcgagagaactgggaatgacgggtgactactggggccagggaaccctggtcaccgtctcctca

SEQ ID NO: 28516 - protein, 117 aa, Artificial Sequence
  Description of Artificial Sequence: Synthetic polypeptide
QVQLVESGGGVVQPGRSLRLTCAASGFTFSDYGIHWVRQAPGKGLEWVAVIWYDESNKYYADSMKGRFTISRDNSKNTLYLQMNSLRAEDTAVYYCARELGMTGDYWGQGTLVTVSS

SEQ ID NO: 28517 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggccgggggctggaatgggtggcagttatatggtatgatggaactgataaatactatgtagactccgtgaagggccgattcaccatctccagagacaattccaagaacacgctgtatctgcaaatgaacagcctgagagccgaggactcggctgtgtattactgtgcgagagaaaatagcagctcgtactactttgactactggggccagggaaccctggtcaccgtctcctca

SEQ ID NO: 28518 - protein, 119 aa, Artificial Sequence
  Description of Artificial Sequence: Synthetic polypeptide
QVQLVESGGGVVQPGRSLRLSCAASGFTFSSYGMHWVRQAPGRGLEWVAVIWYDGTDKYYVDSVKGRFTISRDNSKNTLYLQMNSLRAEDSAVYYCARENSSSYYFDYWGQGTLVTVSS

SEQ ID NO: 28519 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgaatctgcaaatgaacagcctgagagccgaggacacgggtgtgtattactgtgcgagaagatatagcagcagctggacggggggtatggacgtctggggccaagggaccacggtcaccgtctcctca

SEQ ID NO: 28520 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLNLQMNSLRAEDTGVYYCARRYSSSWTGGMDVWGQGTTVTVSS

SEQ ID NO: 28521 - DNA, 354 bp, Artificial Sequence
  Description of Artificial Sequence: Synthetic polynucleotide
caggtgctcctggtgcagtctggggctgaggtgaagaggcctggggcctcagtgaaggtctcctgcaaggcttctggatacaccttcaccaattatgatattaattgggtgcgacaggccactggacaagggcttgagtggatgggatggatgtaccctaacagtggtaacacaggctatgcacagaaattccagggcagagtcaccatgaccaggaacacctccataagcacagcctacatggagctgagcagcctgagatctgaggacacggccgtctattactgtgcgagtagcagtggctggtactactttgactactggggccagggaaccctggtcaccgtctcctca

SEQ ID NO: 28522 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMYPNSGNTGYAQKFQGRVTMTRNTSISTAYMELSSLRSEDTAVYYCASSSGWYYFDYWGQGTLVTVSS

SEQ ID NO: 28523 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattccccttcaataactatggcatgcactgggtccgccaggctccaggcaaggggctggagtgggtgtcaattatatggtatgatggaagttataaatactatgcagactccgtgaagggccgattcaccatctccagagacaattccaagaacacgctgtatctgcaaatgaacagcctgagagccgaggacacggctgtgtattactgtgcgagagagggatacgatttttggagtggcttctttgactcctggggccagggaaccctggtcaccgtctcctca

SEQ ID NO: 28524 - protein, 121 aa, Artificial Sequence
  Description of Artificial Sequence: Synthetic polypeptide
QVQLVESGGGVVQPGRSLRLSCAASGFPFNNYGMHWVRQAPGKGLEWVSIIWYDGSYKYYADSVKGRFTISRDNSKNTLYLQMNSLRAEDTAVYYCAREGYDFWSGFFDSWGQGTLVTVSS

SEQ ID NO: 28525 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaagtaataaatactatggagactccgtgaagggccgattcaccatctccagagacaattccaagaatatgctgtatctgcaaatgaacagcctgagaggcgaggacacggctctgtattactgtgcgagagaactggggttcctctctgactactggggccagggaaccctggtcaccgtctcctca

SEQ ID NO: 28526 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDESNKYYGDSVKGRFTISRDNSKNMLYLQMNSLRGEDTALYYCARELGFLSDYWGQGTLVTVSS

SEQ ID NO: 28527 - DNA, 354 bp, Artificial Sequence
  Description of Artificial Sequence: Synthetic polynucleotide
caggtgctcctggtgcagtctggggctgaggtgaagaggcctggggcctcagtgaaggtctcctgcaaggcttctggatacaccttcaccaattatgatattaattgggtgcgacaggccactggacaaggtcttgagtggatgggatggatgcaccctgacagtggtaacacaggctatgcacagaagttccagggcagagtcaccatgaccaggaacacctccataagcacggcctacatggagctgagcagcctgagatctgaggacacggccgtgtattactgtgcgagtagcagtggctggtactactttgactactggggccagggaaccctggtcaccgtctcctca

SEQ ID NO: 28528 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMHPDSGNTGYAQKFQGRVTMTRNTSISTAYMELSSLRSEDTAVYYCASSSGWYYFDYWGQGTLVTVSS

SEQ ID NO: 28529 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagcagctggtcagggggtatggacgtctggggccaagggaccacggtcaccgtctcctca

SEQ ID NO: 28530 - protein, 121 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARRYSSSWSGGMDVWGQGTTVTVSS

SEQ ID NO: 28531 - DNA, 351 bp, Artificial Sequence
  Description of Artificial Sequence: Synthetic polynucleotide
caggtgcagctggtggagtctgggggaggcgtggtccagcctgggaggtccctgaaactctcctgttcagcgtctggattcaccttcagtgactatggcattcactgggtccgccaggctccaggcaaggggctggagtgggtggcagttatatggtatgatgaaagtaataactactatgcagactccgtgaagggccgattcaccatctccagagacaattccaagaacacgctgtatctgcaaatgaacagcctgagagccgaggacacggctgtgtactactgtgcgagagaaattggctggttagatgactactggggccagggaacccaggtcaccgtctcctca

SEQ ID NO: 28532 - protein, 117 aa, Artificial Sequence
  Description of Artificial Sequence: Synthetic polypeptide
QVQLVESGGGVVQPGRSLKLSCSASGFTFSDYGIHWVRQAPGKGLEWVAVIWYDESNNYYADSVKGRFTISRDNSKNTLYLQMNSLRAEDTAVYYCAREIGWLDDYWGQGTQVTVSS

SEQ ID NO: 28533 - DNA, 369 bp, Artificial Sequence
  Description of Artificial Sequence: Synthetic polynucleotide
gaggtgcaggtgttggagtctgggggaggcttggtacagcctggggggtccctgagactctcctgtgcagcctctggattcacctttagcagctgtgccatgaactgggtccgccaggctccagggaaggggctggagtgggtctccgctattagtggtcgtggtggtagcacattctacgcagactccgtgaagggccggttcaccatctccagagacaattccaagaacacgctgtatctgcaaatgaacagcctgagagccgaggacacggccgtatattactgtgcgaaaggggagctactagaggactactactactacggaatggacgtctggggccaagggaccacggtcaccgtctcctca

SEQ ID NO: 28534 - protein, 123 aa, Artificial Sequence
  Description of Artificial Sequence: Synthetic polypeptide
EVQVLESGGGLVQPGGSLRLSCAASGFTFSSCAMNWVRQAPGKGLEWVSAISGRGGSTFYADSVKGRFTISRDNSKNTLYLQMNSLRAEDTAVYYCAKGELLEDYYYYGMDVWGQGTTVTVSS

SEQ ID NO: 28535 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggaagcatattccacgcagactccgtgaagggccggttcaccatctccagagacaattccaagaacacgctgtatctgcaaatgaacagcctgagagccgaggacacggccgtatattactgtgtgaaaggggagctactagaggactactacttctacggtatggacgtctggggccaagggaccacggtcaccgtctcctca

SEQ ID NO: 28536 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSIFHADSVKGRFTISRDNSKNTLYLQMNSLRAEDTAVYYCVKGELLEDYYFYGMDVWGQGTTVTVSS

SEQ ID NO: 28537 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatacactgggtccgccaggctccaggcaaggggctggagtgggtggcagttatttggtatgatggaaataataaatattatgcagactccgtgaagggccgattcaccatctccagagacaattccaagaacacgctgtatctgcaaatgaacaacctgagagccgaggacacggctgtgtattactgtgcgagagaaattggctggttagatgactactggggccagggaaccctggtcaccgtctcctca

SEQ ID NO: 28538 - protein, 117 aa, Artificial Sequence
  Description of Artificial Sequence: Synthetic polypeptide
QVQLVESGGGVVQPGRSLRLSCAASGFTFSDYGIHWVRQAPGKGLEWVAVIWYDGNNKYYADSVKGRFTISRDNSKNTLYLQMNNLRAEDTAVYYCAREIGWLDDYWGQGTLVTVSS

SEQ ID NO: 28539 - DNA, 345 bp, Artificial Sequence
  Description of Artificial Sequence: Synthetic polynucleotide
gaggtgcagttggtggagtctgggggaggcttggtacagcctggggggtccctgagactctcctgtgcagcctctggattcaccttcagtagctataggatgaactgggtccgccaggctccagggaaggggctggagtgggtttcatccattagtagtagtagtagtaccatatactacgcagactctgtgaagggccgattcaccatctccagagacaatgccaagaactcactgtatctgcaaatgaacagcctgagagacgaggacacggctgtgtattactgtgcgagaacggctggttttgactactggggccagggaaccctggtcaccgtctcctca

SEQ ID NO: 28540 - protein, 115 aa, Artificial Sequence
  Description of Artificial Sequence: Synthetic polypeptide
EVQLVESGGGLVQPGGSLRLSCAASGFTFSSYRMNWVRQAPGKGLEWVSSISSSSSTIYYADSVKGRFTISRDNAKNSLYLQMNSLRDEDTAVYYCARTAGFDYWGQGTLVTVSS

SEQ ID NO: 28541 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatggcatgaactgggtccgccaggctccagggaaggggctggagtgggtctcatccattagtggtagtagtagttacatatactacgcggactcagtgaagggccgattcaccatctccagagacaacgccaagaactcactgtatctgcaaatgaacagcctgagagccgaggacacggctgtgtattactgtgcgagactgactacctttgacttctggggccagggaaccctggtcaccgtctcctca

SEQ ID NO: 28542 - protein, 115 aa, Artificial Sequence
  Description of Artificial Sequence: Synthetic polypeptide
EVQLVESGGGLVKPGGSLRLSCAASGFTFSSYGMNWVRQAPGKGLEWVSSISGSSSYIYYADSVKGRFTISRDNAKNSLYLQMNSLRAEDTAVYYCARLTTFDFWGQGTLVTVSS

SEQ ID NO: 28543 - DNA, 363 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagcagctatgccatgagctgggtccgccaggctccagggaagggtctggagtgggtctcagttattagtggtagtggtgttaacacattctacgcagactccgtgaagggccggttcaccatctccagagacaattccaagaacacgctgtatctgctaatgaacagcctgagagccgaggacacggccgtatattactgtgcgaaaaagatagcagtggctggtactcactactttgactactggggccagggaaccctggtcaccgtctcctca

SEQ ID NO: 28544 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGSGVNTFYADSVKGRFTISRDNSKNTLYLLMNSLRAEDTAVYYCAKKIAVAGTHYFDYWGQGTLVTVSS

SEQ ID NO: 28545 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagcagctatggcatgcactgggtccgccaggctccaggcaaggggctggagtgggtggcagttatatggtatgatggaagtaataaatactatgcagactccgtgaagggccgattcaccatctccagagacaattccaagaacacgctatatctacaaatgaacagcctgagagccgaggacacggctgtgtatcactgtgcgagagattcctccccctacggtatggacgtctggggccaagggaccacggtcaccgtctcctca

SEQ ID NO: 28546 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYHCARDSSPYGMDVWGQGTTVTVSS

SEQ ID NO: 28547 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaagtaataaatactatgcagactccgtgaagggccgattcaccatctccagagacaattccaagaacacgctgtatctgcaaatgaacagcctgagagccgaggacacggctgtgtattactgtgcgagagaattaggctggtacgacgactactggggccagggaaccctggtcaccgtctcctct

SEQ ID NO: 28548 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDESNKYYADSVKGRFTISRDNSKNTLYLQMNSLRAEDTAVYYCARELGWYDDYWGQGTLVTVSS

SEQ ID NO: 28549 - DNA, 354 bp, Artificial Sequence
  Description of Artificial Sequence: Synthetic polynucleotide
caggtgctcctggtgcagtctggggctgaggtgaagaggcctggggcctcagtgaaggtctcctgcaaggcttctggatacaccttcaccaattatgatattaattgggtgcgacaggccactggacaagggcttgagtggatgggatggatgcaccctaacagtggtaacacaggctatgcacagaaattccagggcagagtcaccatgaccaggaacacctccataagcacagcctacatggagctgagcagcctgagatctgaggacacggccgtctattactgtgcgagtagcagtggctggtactactttgactactggggccagggaaccctggtcaccgtctcctca

SEQ ID NO: 28550 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMHPNSGNTGYAQKFQGRVTMTRNTSISTAYMELSSLRSEDTAVYYCASSSGWYYFDYWGQGTLVTVSS

SEQ ID NO: 28551 - DNA, 345 bp, Artificial Sequence
  Description of Artificial Sequence: Synthetic polynucleotide
gaggtgcagctgttggagtctgggggaggcctggtacagccgggggggtccctgagactctcctgtgcagcctctggattcacctttagcagctatgtcatgaactgggtccgccaggctccagggaaggggctggagtgggtctcagctattagtggtagtggtggtagcacatactacgcagactccgtgaagggccggttcaccatctccagaaacaattccaagaacacgctgtatctgcaaatgaacagcctgagagccgaggacacggccgtatattactgtgcgcgaactggggtctttgactactggggccagggaaccctggtcaccgtctcctca

SEQ ID NO: 28552 - protein, 115 aa, Artificial Sequence
  Description of Artificial Sequence: Synthetic polypeptide
EVQLLESGGGLVQPGGSLRLSCAASGFTFSSYVMNWVRQAPGKGLEWVSAISGSGGSTYYADSVKGRFTISRNNSKNTLYLQMNSLRAEDTAVYYCARTGVFDYWGQGTLVTVSS

SEQ ID NO: 28553 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagacgaggacacggccgtatattactgtgtgaaaggggagctactagaggactactacttctacggtatggacgtctggggccaagggaccacggtcaccgtctcctca

SEQ ID NO: 28554 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFHADSVKGRFTISRDNSKNTLYLQMNSLRDEDTAVYYCVKGELLEDYYFYGMDVWGQGTTVTVSS

SEQ ID NO: 28555 - DNA, 348 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatcaacagcctgagagccgaggacacggctgtgtattactgtgcgagaggcaatatagcaagggactactggggccagggaaccctggtcaccgtctcctca

SEQ ID NO: 28556 - protein, 116 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQINSLRAEDTAVYYCARGNIARDYWGQGTLVTVSS

SEQ ID NO: 28557 - DNA, 351 bp, Artificial Sequence
  Description of Artificial Sequence: Synthetic polynucleotide
caggtgcagctggtggagtctgggggaggcgtggtccagcctgggaggtccctgagagtctcctgtacagcgtctggattcaccctcagaaactatggcatgcactgggtccgccaggctccaggcaaggggctggagtgggtggcagttatatggtatgaggaaagtaataaatactatacagagtccgtgaagggccgattcaccatctccagagacaattccaagaacacgctgtatctgcaaatgaacagcctgagagccgaggacacggctgtgtattactgtgcgagagaactggggttcctctctgactactggggccagggaaccctggtcaccgtctcctca

SEQ ID NO: 28558 - protein, 117 aa, Artificial Sequence
  Description of Artificial Sequence: Synthetic polypeptide
QVQLVESGGGVVQPGRSLRVSCTASGFTLRNYGMHWVRQAPGKGLEWVAVIWYEESNKYYTESVKGRFTISRDNSKNTLYLQMNSLRAEDTAVYYCARELGFLSDYWGQGTLVTVSS

SEQ ID NO: 28559 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaaggaagtaataaatactatgtagactccgtgaagggccgattcaccatctccagagacaattccaagaacacgctgtatctgcaaatgaacagcctgagagccgaggacacggctgtgtattactgtgcgagagaattaggctggtacgacgactactggggccagggaaccctggtcaccgtctcctca

SEQ ID NO: 28560 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYEGSNKYYVDSVKGRFTISRDNSKNTLYLQMNSLRAEDTAVYYCARELGWYDDYWGQGTLVTVSS

SEQ ID NO: 28561 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactgtgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggagtatagcagtggctggtacgactacggtatggacgtctggggccaagggaccacggtcaccgtctcctca

SEQ ID NO: 28562 - protein, 123 aa, Artificial Sequence
  Description of Artificial Sequence: Synthetic polypeptide
QVQLVESGGGVVQPGRSLRLSCAASGFTFSNCVMHWVRQAPGKGLEWVAVIWYDGSNKYYADSVKGRFTISRDNSKNTLYLQMNSLRAEDTAVYYCAREEYSSGWYDYGMDVWGQGTTVTVSS

SEQ ID NO: 28563 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcctgaactgggtccgccaggctccagggaaggggctggagtgggtctcatccattagtggtagtagtagtaacatatactacacagactcagtgaagggccgattcaccatctccagagacaacgccaagaactcactgtttctgcaaatgaacagcctgagagccgaggacacggctgtgtattactgtgcgagagtggcgtcctttgactactggggccagggaaccctggtcaccgtctcctca

SEQ ID NO: 28564 - protein, 115 aa, Artificial Sequence
  Description of Artificial Sequence: Synthetic polypeptide
EVQLVESGGGLVKPGGSLRLSCAASGFTFSSYSLNWVRQAPGKGLEWVSSISGSSSNIYYTDSVKGRFTISRDNAKNSLFLQMNSLRAEDTAVYYCARVASFDYWGQGTLVTVSS

SEQ ID NO: 28565 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtgacagttatatggtatgatgcaaataataaatactatgcagactccgtgaagggccgattcaccatctccagagacaatttcaaaaacacggtgtatctgcaaatgaacagcctgagagccgaggacacggctgtgtattactgtgcgagagaaattggctggttagatgactactggggccagggaaccctggtcaccgtctcctca

SEQ ID NO: 28566 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVTVIWYDANNKYYADSVKGRFTISRDNFKNTVYLQMNSLRAEDTAVYYCAREIGWLDDYWGQGTLVTVSS

SEQ ID NO: 28567 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtgacagttatatggtataatgaaaataataaatactatgcagactccgtgaagggccgattcaccatctccagagacaattccaagaacacgctgtatctgcaaatgaacagcctgagagccgaggacacggctgtgtattactgtgcgagagaactggggatgacgggtgactcctggggccagggaaccctggtcaccgtctcctca

SEQ ID NO: 28568 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVTVIWYNENNKYYADSVKGRFTISRDNSKNTLYLQMNSLRAEDTAVYYCARELGMTGDSWGQGTLVTVSS

SEQ ID NO: 28569 - DNA, 369 bp, Artificial Sequence
  Description of Artificial Sequence: Synthetic polynucleotide
gaggtgcaggtgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagccgaggacacggccgtatattactgtgtgaaaggggagctactagaggactactacttctacggtttggacgtctggggccaagggaccacggtcaccgtctcctca

SEQ ID NO: 28570 - protein, 123 aa, Artificial Sequence
  Description of Artificial Sequence: Synthetic polypeptide
EVQVLESGGGLVQPGGSLRLSCAASGFTFSSYAMSWVRQAPGKGLEWVSAISGRGGSTFHADSVKGRFTISRDNSKNTLYLQMNSLRAEDTAVYYCVKGELLEDYYFYGLDVWGQGTTVTVSS

SEQ ID NO: 28571 - DNA, 360 bp, Artificial Sequence
  Description of Artificial Sequence: Synthetic polynucleotide
gaggtgcagctgttggagtctgggggagacatggtccagcctggggggtccctgagactctcctgtgcagcctccggattcacctttagcatctatgccatgagctgggtccgccaggctccagggaaggggctggagtgggtctcagttattagtggtagtggtggtagctcattctacgcagactccgtgaagggccggttcaccatctccagagacaattccaagaacacgctgtatctgcaaatgaacagcctgagagccgaggacacggccgtatattactgtacgaaagatcgggtgaaagctcatgatggttttgatatctggggccaagggacaatggtcaccgtctcttca

SEQ ID NO: 28572 - protein, 120 aa, Artificial Sequence
  Description of Artificial Sequence: Synthetic polypeptide
EVQLLESGGDMVQPGGSLRLSCAASGFTFSIYAMSWVRQAPGKGLEWVSVISGSGGSSFYADSVKGRFTISRDNSKNTLYLQMNSLRAEDTAVYYCTKDRVKAHDGFDIWGQGTMVTVSS

SEQ ID NO: 28573 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaagaacacgctgtatctacaactgaacagcctgagagccgatgacacggccgtatattactgtgtgaaaggggagctactagaggactactacttctacggtatggacgtctggggccaagggaccacggtcaccgtctcctca

SEQ ID NO: 28574 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFHADSVKGRFTISRDNSKNTLYLQLNSLRADDTAVYYCVKGELLEDYYFYGMDVWGQGTTVTVSS

SEQ ID NO: 28575 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaaataataaatactatgcagactccgtgaagggccgattcaccatctccagagacaattccaagaacacgctgtatctgcaaatgaacagcctgagagccgaggacacggctctgtattactgtgcgacagaactggggatgacgggtgactcctggggccagggaaccctggtcaccgtctcctca

SEQ ID NO: 28576 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNKYYADSVKGRFTISRDNSKNTLYLQMNSLRAEDTALYYCATELGMTGDSWGQGTLVTVSS

SEQ ID NO: 28577 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaagtaataaatactatgcagactccatgaagggccgattcaccatctccagagacaattccaagaacacgctgtatctgcaaatgaacagcctgagagccgaggacacggctgtgtattactgtgcgagagaactggggatgacgggtgactactggggccagggaaccctggtcaccgtctcctca

SEQ ID NO: 28578 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDESNKYYADSMKGRFTISRDNSKNTLYLQMNSLRAEDTAVYYCARELGMTGDYWGQGTLVTVSS

SEQ ID NO: 28579 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggcctctggacaagggcttgagtggatgggatggatgaaccctaacagtggtaacacaggctatgcacagagattccagggcagagtcaccatgaccaggaacacctccataaacacagcctacatggagctgagcagcctgagatctgaggacacggccgtatattactgtgcgagtagcagtggctggtactactttgactactggggccagggaaccctggtcaccgtctcctca

SEQ ID NO: 28580 - protein, 118 aa, Artificial Sequence
  Description of Artificial Sequence: Synthetic polypeptide
QVQLVQSGAEVKKPGASVKVSCKASGYTFTNYDINWVRQASGQGLEWMGWMNPNSGNTGYAQRFQGRVTMTRNTSINTAYMELSSLRSEDTAVYYCASSSGWYYFDYWGQGTLVTVSS

SEQ ID NO: 28581 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcaacagctggtcagggggtatggacgtctggggccaagggaccacggtcaccgtctcctca

SEQ ID NO: 28582 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRYSNSWSGGMDVWGQGTTVTVSS

SEQ ID NO: 28583 - DNA, 366 bp, Artificial Sequence
  Description of Artificial Sequence: Synthetic polynucleotide
gaggtgcagctgttggagtctgggggaggcttggtacagcctggggggtccctgagattgtcctgtgcagcctctggattcacctttagcagctatgccatgagctgggtccgccaggctccagggaaggggctggagtgggtctcagctattagtggtagtggaggtaacacattctacgcagactccgtgaagggccggttcaccatctccagagacaattccaagaacacgctgtatctgcaaatgaacagcctgagagccgaggacacggccgtatattactgtgcgaaattggggcgtatagcagtgactggtccttactttgactactggggccagggaaccctggtcaccgtctcctca

SEQ ID NO: 28584 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGNTFYADSVKGRFTISRDNSKNTLYLQMNSLRAEDTAVYYCAKLGRIAVTGPYFDYWGQGTLVTVSS

SEQ ID NO: 28585 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtttgatggaagtaataaatactatgcagactccgtgaagggccgattcaccatctccagagacaattccaagaacacgctgtttctgcaaatgaacagcctgagagtcgaggacacggctgtgtattactgtgcgagagaaattggctggttagatgactactggggccagggaaccctggtcaccgtctcctca

SEQ ID NO: 28586 - protein, 117 aa, Artificial Sequence
  Description of Artificial Sequence: Synthetic polypeptide
QVQLVESGGGVVQPGRSLRLSCAASGFTFSSYGIHWVRQAPGKGLEWVAVIWFDGSNKYYADSVKGRFTISRDNSKNTLFLQMNSLRVEDTAVYYCAREIGWLDDYWGQGTLVTVSS

SEQ ID NO: 28587 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaagtaataaatactatggagactccgtgaagggccgattcaccatctccagagacaattccaagaacacgctgtatctgcaaatgaacagcctgagaggcgaggacacggctctgtattactgtgcgagagaactggggttcctctctgactactggggccagggaaccctggtcaccgtctcctca

SEQ ID NO: 28588 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDESNKYYGDSVKGRFTISRDNSKNTLYLQMNSLRGEDTALYYCARELGFLSDYWGQGTLVTVSS

SEQ ID NO: 28589 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactatggcatgcactgggtccgccaggctccaggcaaggggctggagtgggtggcagttatatggcatgatggaagtaataaatactatgtagactccgtgaagggccgattcaccatctccagagacaattccaagaacacgctgtatctgcaaatgaacagcctgagagccgaggacacggctgtgtattactgtgcgagagaaaatagcagttcgtactactttgactactggggccagggaaccctggtcaccgtctcctca

SEQ ID NO: 28590 - protein, 119 aa, Artificial Sequence
  Description of Artificial Sequence: Synthetic polypeptide
QVQLVESGGGVVQPGRSLRLSCAASGFTFSYYGMHWVRQAPGKGLEWVAVIWHDGSNKYYVDSVKGRFTISRDNSKNTLYLQMNSLRAEDTAVYYCARENSSSYYFDYWGQGTLVTVSS

SEQ ID NO: 28591 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattcaacgcagactccgtgaagggccggttcaccatctccagagacaattccaagaccacgctgtatctgcaaatgaacagcctgagagccgaggacacggccgtatattactgtgtgaaaggggagctactagaggactactacttctacggtatggacgtctggggccaagggaccacggtcaccgtctcctca

SEQ ID NO: 28592 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFNADSVKGRFTISRDNSKTTLYLQMNSLRAEDTAVYYCVKGELLEDYYFYGMDVWGQGTTVTVSS

SEQ ID NO: 28593 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatcaattagtagtagtagtagttacatatactacgcagactcagtgaagggccgattcaccatctccagagacaacgccaagaactcactgtatctgcaaatgaacagcctgagagccgaggacacggctgtgtattactgtgcgagagatcgaggcagcagctggggccagggaaccctggtcaccgtctcctca

SEQ ID NO: 28594 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGSSWGQGTLVTVSS

SEQ ID NO: 28595 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttattagtggtggtggtggtagcacatactacgcagactccgtgaagggccggttcaccatctccagagacaattccaagaacacgctgtatctgcaaatgaacagcctgagagccgaggacacggccgtatattactgtgcgaaacgtggatatagtggctacgaggacctcctctactttgactgctggggccagggaaccctggtcaccgtctcctca

SEQ ID NO: 28596 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSVISGGGGSTYYADSVKGRFTISRDNSKNTLYLQMNSLRAEDTAVYYCAKRGYSGYEDLLYFDCWGQGTLVTVSS

SEQ ID NO: 28597 - DNA, 363 bp, Artificial Sequence
  Description of Artificial Sequence: Synthetic polynucleotide
caggtgcagctggtggagtctgggggaggcgtggtccagcctgggaggtccctgagactgtcctgtgcagcgtctggattcaccttcagtagctatggcatgcactgggtccgccaggctccaggcaaggggctggagtgggtggcagttatatggtatgatggaagtaataaatattatgcagactccgtgaagggccgattcaccatctccagagacaattccaataacacgctgtatctgcaaatgaacagcctgagagccgaggacacggctgtgtattactgtgcgagaaggtatagcagcagctggtcagggggtatggacgtctggggccaagggaccacggtcaccgtctcctca

SEQ ID NO: 28598 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSNNTLYLQMNSLRAEDTAVYYCARRYSSSWSGGMDVWGQGTTVTVSS

SEQ ID NO: 28599 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagcagttatggcatgcactgggtccgccaggctccaggcaaggggctggagtgggtggcagttatatggtatgatggaagtaatgaatactatgcagactccgtgaagggccgattcaccatctccagagacaattccaagaacacgctatatctacaaatgaacagcctgagagccgcggacacggctgtgtattactgtgcgagagattcctccccctacggtatggacgtctggggccaagggaccacggtcaccgtctcctca

SEQ ID NO: 28600 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNEYYADSVKGRFTISRDNSKNTLYLQMNSLRAADTAVYYCARDSSPYGMDVWGQGTTVTVSS

SEQ ID NO: 28601 - DNA, 354 bp, Artificial Sequence
  Description of Artificial Sequence: Synthetic polynucleotide
gaggtgcagctgttggagtctgggggaggcttggtacagccgggggggtccctgagactctcctgtgcagcctctggattcatctttagcagctatgccatgagctgggtccgccaggctccagggaaggggctggagtgggtctcagttactagtggtagtggtggtaccacattctacgcagactccgtgaagggccggttcaccatctccagagacaattccaagaacacgctttatctgcaaatgaacagcctgagagccgaggacacggccgtttattactgtgcgaaacggacccagtttgatgattttgatatctggggccaagggacaatggtcaccgtctcttca

SEQ ID NO: 28602 - protein, 118 aa, Artificial Sequence
  Description of Artificial Sequence: Synthetic polypeptide
EVQLLESGGGLVQPGGSLRLSCAASGFIFSSYAMSWVRQAPGKGLEWVSVTSGSGGTTFYADSVKGRFTISRDNSKNTLYLQMNSLRAEDTAVYYCAKRTQFDDFDIWGQGTMVTVSS

SEQ ID NO: 28603 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaaataataaatactatgcagactccgtgaagggccgattcaccatctccagagacaattccaagaacacgctgtatctgcaaatgaacagcctgagagccgaggacacggctgtgtattactgtgcgagagaactggggatgacgggtgactcctggggccagggaaccctggtcaccgtctcctca

SEQ ID NO: 28604 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNKYYADSVKGRFTISRDNSKNTLYLQMNSLRAEDTAVYYCARELGMTGDSWGQGTLVTVSS

SEQ ID NO: 28605 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatggtggaagtaataaattctatgcagtctccgtgaagggccgattcaacatctccagagacaattccaagaacacgctgtatctgcaaatgaacagcctgagagctgaggacacggctgtgtattactgtgtgagaagggggtatagcagtggaggctacggtatggacgtctggggccaagggaccacggtcaccgtctcctca

SEQ ID NO: 28606 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYGGSNKFYAVSVKGRFNISRDNSKNTLYLQMNSLRAEDTAVYYCVRRGYSSGGYGMDVWGQGTTVTVSS

SEQ ID NO: 28607 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtattactgtgcgagagatagggggagcctctggggccagggaaccctggtcaccgtctcctca

SEQ ID NO: 28608 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARDRGSLWGQGTLVTVSS

SEQ ID NO: 28609 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctgtgccatgaactgggtccgccaggctccagggaaggggctggagtgggtctcagctattagtggtagtggtggtagctcattctacgcagactccgtgaagggccggttcaccatctccagagacaattccaagaacacgctgtatctgcaaatgaacagcctgagagccgaggacacggccgtatattactgtgcgaaacggactccctatgatgtctttgatatctggggccaagggacaatggtcaccgtctcttca

SEQ ID NO: 28610 - protein, 118 aa, Artificial Sequence
  Description of Artificial Sequence: Synthetic polypeptide
EVQLLESGGGLVQPGGSLRLSCAASGFTFSSCAMNWVRQAPGKGLEWVSAISGSGGSSFYADSVKGRFTISRDNSKNTLYLQMNSLRAEDTAVYYCAKRTPYDVFDIWGQGTMVTVSS

SEQ ID NO: 28611 - DNA, 342 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccagacaaggggctggagtgggtggcagttatatggtatgatgaaaatactaaatactatgcagactccgtgaagggccgattcaccatctccagagacaattccaagaacacgctgtatctgcaaatgaacagcctgagagccgaggacacggctgtgtattactgtgcgagagagtggggggactactggggccagggaaccctggtcaccgtctcctca

SEQ ID NO: 28612 - protein, 114 aa, Artificial Sequence
  Description of Artificial Sequence: Synthetic polypeptide
QVQLVESGGGVVQPGRSLRLSCAASGFTFSDYGMHWVRQAPDKGLEWVAVIWYDENTKYYADSVKGRFTISRDNSKNTLYLQMNSLRAEDTAVYYCAREWGDYWGQGTLVTVSS

SEQ ID NO: 28613 - DNA, 360 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccagactccagggcaggggctggagtgggtctcagctattagtggtagaggtggtaccacattctacgcagactccgtgaagggccggttcaccatctccagagacaattccaagaacacgctgtatctgcaaatgaacagcctgagagccgaggacacggccgtatattactgtgcgaaagacgggtacggtggtaactccttctttgactactggggccagggaaccctggtcaccgtctcctca

SEQ ID NO: 28614 - protein, 120 aa, Artificial Sequence
  Description of Artificial Sequence: Synthetic polypeptide
EVQLLESGGGLVQPGGSLRLSCAASGFTFSSYAMSWVRQTPGQGLEWVSAISGRGGTTFYADSVKGRFTISRDNSKNTLYLQMNSLRAEDTAVYYCAKDGYGGNSFFDYWGQGTLVTVSS

SEQ ID NO: 28615 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaaataatgaatactatgcagactccgtgaagggccgattcaccatctccagagacaattccaagaacacgctgtatctgcaaatgaacagcctgagagccgaggacacggctgtgtattactgtgcgagagaactggggatgacgggtgactcctggggccagggaaccctggtcaccgtctcctca

SEQ ID NO: 28616 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNEYYADSVKGRFTISRDNSKNTLYLQMNSLRAEDTAVYYCARELGMTGDSWGQGTLVTVSS

SEQ ID NO: 28617 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtggctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtacgatttttggagtggttgtatggacgtctggggccaagggaccacggtcaccgtctcctca

SEQ ID NO: 28618 - protein, 121 aa, Artificial Sequence
  Description of Artificial Sequence: Synthetic polypeptide
QVQLVESGGGVVQPGRSLRLSCAASGFTFSGYGMHWVRQAPGKGLEWVAIIWYDGSNKYYADSVKGRFTISRDNSKNTLYLQMNSLRAEDTAVYYCARERYDFWSGCMDVWGQGTTVTVSS

SEQ ID NO: 28619 - DNA, 351 bp, Artificial Sequence
  Description of Artificial Sequence: Synthetic polynucleotide
caggagcagctggtggagtctgggggaggcgtggtccagcctgggaggtccctgagactctcctgtgcagcgtctggattcatcttcagtgactatggcatgcactgggtccgccaggctccaggcaaggggctggagtgggtggcagttatatggtatgatgaaaataataaatactatgtagactccgtgaggggccgattcaccatctccagagacaattccaagaacacgctgtatctgcaaatgaacagcctgagagccgaggacacggctgtgtattactgtgcgagagaactggggatgacgggtgactcctggggccagggaaccctggtcaccgtctcctca

SEQ ID NO: 28620 - protein, 117 aa, Artificial Sequence
  Description of Artificial Sequence: Synthetic polypeptide
QEQLVESGGGVVQPGRSLRLSCAASGFIFSDYGMHWVRQAPGKGLEWVAVIWYDENNKYYVDSVRGRFTISRDNSKNTLYLQMNSLRAEDTAVYYCARELGMTGDSWGQGTLVTVSS

SEQ ID NO: 28621 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcatcttcagtacctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgatacgatttttggagtggttattttgactactggggccagggaaccctggtcaccgtctcctca

SEQ ID NO: 28622 - protein, 121 aa, Artificial Sequence
  Description of Artificial Sequence: Synthetic polypeptide
QVQLVESGGGVVQPGRSLRLSCAASGFIFSTYGMHWVRQAPGKGLEWVAVIWYDGSNKYYADSVKGRFTISRDNSKNTLYLQMNSLRAEDTAVYYCARDRYDFWSGYFDYWGQGTLVTVSS

SEQ ID NO: 28623 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagggactatggcatacactgggtccgccaggctccaggcaaggggctggagtgggtggcagttatatggtttgatggaactaataaatactatgcagactccgtgaagggccgattcaccatctccagagacaattccaagaacacgctgtatctgcaaatgaacagcctgagagccgaagacacggctgtgtattactgtgggagagaaattggctggttagatgactactggggccagggaaccctggtcaccgtctcctca

SEQ ID NO: 28624 - protein, 117 aa, Artificial Sequence
  Description of Artificial Sequence: Synthetic polypeptide
QVQLVESGGGVVQPGRSLRLSCAASGFTFRDYGIHWVRQAPGKGLEWVAVIWFDGTNKYYADSVKGRFTISRDNSKNTLYLQMNSLRAEDTAVYYCGREIGWLDDYWGQGTLVTVSS

SEQ ID NO: 28625 - DNA, 369 bp, Artificial Sequence
  Description of Artificial Sequence: Synthetic polynucleotide
gaggtgcaggtgttggagtctgggggaggcttggtacagcctggggggtccctgagactctcctgtgcagcctctggattcacctttagcagctatgccatgaactgggtccgccaggctccagggaaggggctggagtgggtctccgctattagtggtcgtggtggtagcacattctacgcagactccgagaagggccggttcaccatctccagagacaattccaagaacacgctgtatctgcaaatgaacagcctgagagccgaggacacggccctatattactgtgcgaaaggggagctattagaggactactactactacggaatggacgtctggggccaagggaccacggtcaccgtctcctca

SEQ ID NO: 28626 - protein, 123 aa, Artificial Sequence
  Description of Artificial Sequence: Synthetic polypeptide
EVQVLESGGGLVQPGGSLRLSCAASGFTFSSYAMNWVRQAPGKGLEWVSAISGRGGSTFYADSEKGRFTISRDNSKNTLYLQMNSLRAEDTALYYCAKGELLEDYYYYGMDVWGQGTTVTVSS

SEQ ID NO: 28627 - DNA, 375 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactactatatgcactgggtgcgacaggcccctggacaggggcttgagtggatgggatggatcaaccctaacagtggtggcacaaactatgcacagaagtttcagggcagggtcaccatgaccagggacacgtccattatgacagcctatatggagctgagcaggctgagatctgacgacacggccgtgtattactgtgcgagagatagtagcaatttcagcaactggtacgattactacggtatggacgtctggggccaagggaccacggtcaccgtctcctca

SEQ ID NO: 28628 - protein, 125 aa, Artificial Sequence
  Description of Artificial Sequence: Synthetic polypeptide
QVQLVQSGAEVKKPGASVKVSCKASGYTFTDYYMHWVRQAPGQGLEWMGWINPNSGGTNYAQKFQGRVTMTRDTSIMTAYMELSRLRSDDTAVYYCARDSSNFSNWYDYYGMDVWGQGTTVTVSS

SEQ ID NO: 28629 - DNA, 363 bp, Artificial Sequence
  Description of Artificial Sequence: Synthetic polynucleotide
caggttcagttggtgcagtctggagctgaggtgaagaagcctggggcctcagtgaaggtctcctgcaaggcttctggttacaccttcaccagctatggtatcagctgggtgcgacaggcccctggacaagggcttgagtggatgggatggatcagcgcttacaatggtaacacaacctatgcacagaagctccggggcagagtcaccatgaccacagacacatccacgagcacagcctacatggatctgaggagcctgagatctgacgacacggccgtgtattactgtgcgagaaccgctgctgggtatagcagcagctggtttgactactggggccagggaaccctggtcaccgtctcctca

SEQ ID NO: 28630 - protein, 121 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTTYAQKLRGRVTMTTDTSTSTAYMDLRSLRSDDTAVYYCARTAAGYSSSWFDYWGQGTLVTVSS

SEQ ID NO: 28631 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactgtgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggagtatagcagtggctggtacgactacggtatggacgtctggggccaagggaccatggtcaccgtctcctca

SEQ ID NO: 28632 - protein, 123 aa, Artificial Sequence
  Description of Artificial Sequence: Synthetic polypeptide
QVQLVESGGGVVQPGRSLRLSCAASGFTFSNCVMHWVRQAPGKGLEWVAVIWYDGSNKYYADSVKGRFTISRDNSKNTLYLQMNSLRAEDTAVYYCAREEYSSGWYDYGMDVWGQGTMVTVSS

SEQ ID NO: 28633 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaaataataaatcctatgcagactccgtgaagggccgattcaccatctccagagacaattccaagaacacgctgtatctgcaaatgaacagcctgagagccgaggacacggctgtgtattactgtgcgagagaactggggatgacgggtgactcctggggccagggaaccctggtcaccgtctcctca

SEQ ID NO: 28634 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNKSYADSVKGRFTISRDNSKNTLYLQMNSLRAEDTAVYYCARELGMTGDSWGQGTLVTVSS

SEQ ID NO: 28635 - DNA, 363 bp, Artificial Sequence
  Description of Artificial Sequence: Synthetic polynucleotide
caggttcagttggtgcagtctggagctgaggtgaagaagcctggggcctcagtgaaggtctcctgcaaggcttctgattacaccttcaccagctatggtatcagctgggtgcgacaggcccctggacaagggcttgagtggatgggatggatcagcgcttacaatggtaacacaacctatgcacagaagctccggggcagagtcaccatgaccacagacacatccacgagcacagcctacatggatctgaggagcctgagatctgacgacacggccgtgtattactgtgcgagaaccgctgctgggtatagcagcagctggtttgactactggggccagggaaccctggtcaccgtctcctca

SEQ ID NO: 28636 - protein, 121 aa, Artificial Sequence
  Description of Artificial Sequence: Synthetic polypeptide
QVQLVQSGAEVKKPGASVKVSCKASDYTFTSYGISWVRQAPGQGLEWMGWISAYNGNTTYAQKLRGRVTMTTDTSTSTAYMDLRSLRSDDTAVYYCARTAAGYSSSWFDYWGQGTLVTVSS

SEQ ID NO: 28637 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaactaataaatactatgcagactccgtgaagggccgattcaccatctccagagacaattccaagaacacgctgtatctgcaaatgaacagcctgagagccgaggacacggctgtgtattactgtgcgagagaactggggatgacgagtgactactggggccagggaaccctggtcaccgtctcctca

SEQ ID NO: 28638 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDETNKYYADSVKGRFTISRDNSKNTLYLQMNSLRAEDTAVYYCARELGMTSDYWGQGTLVTVSS

SEQ ID NO: 28639 - DNA, 351 bp, Artificial Sequence
  Description of Artificial Sequence: Synthetic polynucleotide
caggtgcagctggtggaatctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgtaagtaataaatactatgcagactccgtgaagggccgattcaccatctccagagacaattccaagaacacgctgtatctgcaaatgaacagcctgagagccgaggacacggctgtgtattactgtgcgagagaaatgggctggtacgatgactactggggccagggaaccctggtcaccgtctcctca

SEQ ID NO: 28640 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDVSNKYYADSVKGRFTISRDNSKNTLYLQMNSLRAEDTAVYYCAREMGWYDDYWGQGTLVTVSS

SEQ ID NO: 28641 - DNA, 369 bp, Artificial Sequence
  Description of Artificial Sequence: Synthetic polynucleotide
gaggtgcaggtgttggagtctgggggaggcttggtacagcctggggggtccctgagactctcctgtgcagcctctggattcacctttagcagctatgccatgaactgggtccgccaggctccagggaaggggctggagtgggtctccgctattagtggtcgtggtggtaacacattctacgcagactccgtgaagggccggttcaccatctccagagacaattccaagaacacgctgtatctgcaaatgaacagcctgagagccgaggacacggccgtatattactgtgcgaaaggggagttactagaggactactactactacggaatggacgtctggggccaagggaccacggtcaccgtctcctca

SEQ ID NO: 28642 - protein, 123 aa, Artificial Sequence
  Description of Artificial Sequence: Synthetic polypeptide
EVQVLESGGGLVQPGGSLRLSCAASGFTFSSYAMNWVRQAPGKGLEWVSAISGRGGNTFYADSVKGRFTISRDNSKNTLYLQMNSLRAEDTAVYYCAKGELLEDYYYYGMDVWGQGTTVTVSS

SEQ ID NO: 28643 - DNA, 369 bp, Artificial Sequence
  Description of Artificial Sequence: Synthetic polynucleotide
gaggtgcagctgttggagtctgggggaggcttgctacagcctggggggtccctgagactctcctgtgcagcctctggattcacctttaatagctatgccatgagctgggtccgccaggctccagggaaggggctggagtgggtctcctctattagtggtcgtggtggtagcacattccacgcagactccgtgaagggccggttcaccatctccagagacaattccaggaacacgctgtatctgcaaatgaacagcctgagagccgaggacacggccgtatattactgtgtgaaaggggagctactagaggactactacttctacggtatggacgtctggggccaagggaccacggtcaccgtctcctca

SEQ ID NO: 28644 - protein, 123 aa, Artificial Sequence
  Description of Artificial Sequence: Synthetic polypeptide
EVQLLESGGGLLQPGGSLRLSCAASGFTFNSYAMSWVRQAPGKGLEWVSSISGRGGSTFHADSVKGRFTISRDNSRNTLYLQMNSLRAEDTAVYYCVKGELLEDYYFYGMDVWGQGTTVTVSS

SEQ ID NO: 28645 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccgggctccaggcaaggggctggagtgggtggcaattatatcatatggtggaagtaataacttctatgcagactccgtgaagggccgattcaccatctccagagacaattccaagaacacgctgtatctgcaaatgaacagcctgagagctgaggacacggctgtgtattactgtgcgagaagggggtatagcagtggaggctacggtatggacgtctggggccaagggaccacggtcaccgtctcctca

SEQ ID NO: 28646 - protein, 121 aa, Artificial Sequence
  Description of Artificial Sequence: Synthetic polypeptide
QVQLVESGGGVVQPGRSLRLSCAASGFTFSSYGMHWVRRAPGKGLEWVAIISYGGSNNFYADSVKGRFTISRDNSKNTLYLQMNSLRAEDTAVYYCARRGYSSGGYGMDVWGQGTTVTVSS

SEQ ID NO: 28647 - DNA, 345 bp, Artificial Sequence
  Description of Artificial Sequence: Synthetic polynucleotide
caggtgcagctggtgcagtctggggctgaggtgaagaagcctggggcctcagtgaaggtctcctgtaaggcttctggatacaccttcaccagttatgatatcaactgggtgcgacaggccactggtcaagggcttgagtggatgggatggatgaaccctaacagtggtaacacaggctatgcacagaagttccagggcagagtcaccatgaccaggaacacctccataagcacagcctacatggagctgagcagcctgggatctgaggacacggccgtgtattactgtgcgagaaagaaggctaacgactactggggccagggaaccctggtcaccgtctcctca

SEQ ID NO: 28648 - protein, 115 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLGSEDTAVYYCARKKANDYWGQGTLVTVSS

SEQ ID NO: 28649 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactatggcatgcactgggtccgccaggctccaggcaaggggctggagtgggtggcagttatatggcatgatggaagtaataaatactatgtagactccgtgaagggccgattcaccatctccagagacaattccaagaacacgctgtatctgcaaatgaacagcctgagagccgaggacacggctgtgtattactgtgcgagagaaaatagcagttcgttctactttgactactggggccagggaaccctggtcaccgtctcctca

SEQ ID NO: 28650 - protein, 119 aa, Artificial Sequence
  Description of Artificial Sequence: Synthetic polypeptide
QVQLVESGGGVVQPGRSLRLSCAASGFTFSYYGMHWVRQAPGKGLEWVAVIWHDGSNKYYVDSVKGRFTISRDNSKNTLYLQMNSLRAEDTAVYYCARENSSSFYFDYWGQGTLVTVSS

SEQ ID NO: 28651 - DNA, 369 bp, Artificial Sequence
  Description of Artificial Sequence: Synthetic polynucleotide
gaggtgcagctggtggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagccgaggacacggccgtatattactgtgtgaaaggggagctactagaggactactacttctacggtatggacgtctggggccaagggaccacggtcaccgtctcctca

SEQ ID NO: 28652 - protein, 123 aa, Artificial Sequence
  Description of Artificial Sequence: Synthetic polypeptide
EVQLVESGGGLVQPGGSLRLSCAASGFTFSSYAMSWVRQAPGKGLEWVSAISGRGGSTFHADSVKGRFTISRDNSKNTLYLQMNSLRAEDTAVYYCVKGELLEDYYFYGMDVWGQGTTVTVSS

SEQ ID NO: 28653 - DNA, 369 bp, Artificial Sequence
  Description of Artificial Sequence: Synthetic polynucleotide
gaggtgcagctggtggagtctgggggaggcttggtacagcctggggggtccctgagactctcctgtgcagcctctggattcacctttagcagctatgccatgaactgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagccgaggacacggccgtatattactgtgtgaaaggggagctattagaggactactacttctacggtatggacgtctggggccaagggaccacggtcaccgtctcctca

SEQ ID NO: 28654 - protein, 123 aa, Artificial Sequence
  Description of Artificial Sequence: Synthetic polypeptide
EVQLVESGGGLVQPGGSLRLSCAASGFTFSSYAMNWVRQAPGKGLEWVSAISGRGGSTFHADSVKGRFTISRDNSKNTLYLQMNSLRAEDTAVYYCVKGELLEDYYFYGMDVWGQGTTVTVSS

SEQ ID NO: 28655 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccagccaaggggctggagtgggtggcagttatatggtatgatagaaataataaatactatgcagactccgtgaagggccgattcaccatctccagagacaattccaagaacacgctgtatctgcaaatgaacagcctgagagccgaggacacggctgtatattactgtgcgagagaaatgggctggtacgatgactactggggccagggaaccctggtcaccgtctcctca

SEQ ID NO: 28656 - protein, 117 aa, Artificial Sequence
  Description of Artificial Sequence: Synthetic polypeptide
QVQLVESGGGVVQPGRSLRLSCAASGFTFSDYGMHWVRQAPAKGLEWVAVIWYDRNNKYYADSVKGRFTISRDNSKNTLYLQMNSLRAEDTAVYYCAREMGWYDDYWGQGTLVTVSS

SEQ ID NO: 28657 - DNA, 369 bp, Artificial Sequence
  Description of Artificial Sequence: Synthetic polynucleotide
gaggtgcagttgttggagtctgggggaggcttggtacagtctggggggtccctgagactctcctgtgaagcctcaggattcatctttagcagctatgccatgaactgggtccgccaggttccagggaaggggctggagtgggtctcagctattagtcgtcgtggtggtagcacattctacgcagactccgtgaagggccggttcaccatttccagagacaattccaagaacacgctgtatctgcaaatgaacagcctgagagccgaggacacggccgtatatttctgtgcgaaaggggaactactagaggactactcctactacggtatcgacgtctggggccaggggaccacggtcaccgtctcctca

SEQ ID NO: 28658 - protein, 123 aa, Artificial Sequence
  Description of Artificial Sequence: Synthetic polypeptide
EVQLLESGGGLVQSGGSLRLSCEASGFIFSSYAMNWVRQVPGKGLEWVSAISRRGGSTFYADSVKGRFTISRDNSKNTLYLQMNSLRAEDTAVYFCAKGELLEDYSYYGIDVWGQGTTVTVSS

SEQ ID NO: 28659 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgagcagcctgagagccgaggacacggctgtgtactactgtgcgagaacaaacggtatggacgtctggggccaagggaccacggttaccgtctcctca

SEQ ID NO: 28660 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMSSLRAEDTAVYYCARTNGMDVWGQGTTVTVSS

SEQ ID NO: 28661 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcactgggtgcgacaggcccctggacaagggcttgactggatgggatggatcaaccctaacagtggtggcacaaactatgcacagaagtttcagggcagggtcaccatgaccagggacacgtccatcagcacagcctatatggagctgagcaggctgagatctgacgacacggccgtgtattactgtgcgagagacggtaccagctcctttgactactggggccagggaaccctggtcaccgtctcctca

SEQ ID NO: 28662 - protein, 117 aa, Artificial Sequence
  Description of Artificial Sequence: Synthetic polypeptide
QVQLVQSGAEVKKPGASVKVSCKASGYTFTGYHMHWVRQAPGQGLDWMGWINPNSGGTNYAQKFQGRVTMTRDTSISTAYMELSRLRSDDTAVYYCARDGTSSFDYWGQGTLVTVSS

SEQ ID NO: 28663 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttataccatgagctgggtccgccaggctccagggaaggggctggagtgggtctcatccattagtggtagtagtaattacatatactacgcagactcagtgaagggccgattcaccatctccagagacaacgccaagaactcactgtatctgcaaatgaacagcctgagagccgaggacacggctgtgtattactgtgcgagattaactggttttgactactggggccagggaaccctggtcaccgtctcctca

SEQ ID NO: 28664 - protein, 115 aa, Artificial Sequence
  Description of Artificial Sequence: Synthetic polypeptide
EVQLVESGGGLVKPGGSLRLSCAASGFTFSSYTMSWVRQAPGKGLEWVSSISGSSNYIYYADSVKGRFTISRDNAKNSLYLQMNSLRAEDTAVYYCARLTGFDYWGQGTLVTVSS

SEQ ID NO: 28665 - DNA, 351 bp, Artificial Sequence
  Description of Artificial Sequence: Synthetic polynucleotide
caggtgcagttggtgcagtctgggactgaggtgaagaagcctggggcctcagtgaaggtctcctgcaaggcttctggatacaccttcaccggcgattatatgcactgggtgcgacaggcccctggacaagggcttgagtggatgggatggatcagccctaaaaatggtggcacaaactatgcacagaagtttcagggcagggtcaccatgaccagggacacgtccatcagcacagcctacatggagctgaacaggctgagatctgacgacacggccgtgtattactgtgcgagagatggaactgggtcctttgactactggggccagggaaccctggtcaccgtctcctca

SEQ ID NO: 28666 - protein, 117 aa, Artificial Sequence
  Description of Artificial Sequence: Synthetic polypeptide
QVQLVQSGTEVKKPGASVKVSCKASGYTFTGDYMHWVRQAPGQGLEWMGWISPKNGGTNYAQKFQGRVTMTRDTSISTAYMELNRLRSDDTAVYYCARDGTGSFDYWGQGTLVTVSS

SEQ ID NO: 28667 - DNA, 351 bp, Artificial Sequence
  Description of Artificial Sequence: Synthetic polynucleotide
caggtgcagctggtgcagtctggggctgaggtgaagaagcctggggcctcaatgaaggtctcctgcaaggcttctggatacaccttcaccgactatcatatgcactgggtgcgacaggcccctggacaagggcttgagtggatgggatggatcaaccctaataggggtggcacaaactatgcacagaagtttcaggacagggtcaccatgaccagggacacgtccatcagcacagcctacatggaactgagcaggctgagatctgacgacacggccgtgtatttctgtgcgagagatggaactgggtcctttgactactggggccagggaaccctggtcaccgtctcctca

SEQ ID NO: 28668 - protein, 117 aa, Artificial Sequence
  Description of Artificial Sequence: Synthetic polypeptide
QVQLVQSGAEVKKPGASMKVSCKASGYTFTDYHMHWVRQAPGQGLEWMGWINPNRGGTNYAQKFQDRVTMTRDTSISTAYMELSRLRSDDTAVYFCARDGTGSFDYWGQGTLVTVSS

SEQ ID NO: 28669 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgacattaactgggtgcgacaggccactggacaagggcttgagtggatgggatggatgcaccctaacagtggtaacacaggctttgcacagaagttccggggcagagtcaccatgaccagaaacacctccataagcacagcctacatggaactgagcagcctgagatctgaggacacggccgtgtattactgtgcgagcagcagtggctggtacttttttgactactggggccagggaaccctggtcaccgtctcctca

SEQ ID NO: 28670 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGFAQKFRGRVTMTRNTSISTAYMELSSLRSEDTAVYYCASSSGWYFFDYWGQGTLVTVSS

SEQ ID NO: 28671 - DNA, 345 bp, Artificial Sequence
  Description of Artificial Sequence: Synthetic polynucleotide
gaggtgcagctgttagagtctgggggaggcttggtacagcctggggggtccctgagactctcctgtgcagcctctggattcacctttagcagctatgtcataaactgggtccgccaggctccagggaaggggctggagtgggtctcagctattagtggtagtggtgttagcacatactacgcagactccgtgaagggccggttcaccatctccagagacaattccaagaacacgctgtatctgcaaatgaacagcctgagagccgaggacacggccgtatattactgtgcgagaacttccctctttgactactggggccagggaaccctggtcaccgtctcctca

SEQ ID NO: 28672 - protein, 115 aa, Artificial Sequence
  Description of Artificial Sequence: Synthetic polypeptide
EVQLLESGGGLVQPGGSLRLSCAASGFTFSSYVINWVRQAPGKGLEWVSAISGSGVSTYYADSVKGRFTISRDNSKNTLYLQMNSLRAEDTAVYYCARTSLFDYWGQGTLVTVSS

SEQ ID NO: 28673 - DNA, 357 bp, Artificial Sequence
  Description of Artificial Sequence: Synthetic polynucleotide
caggtgcagttggtggaatctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaaatagcagctcgtactactttgactactggggccagggaaccctggtcaccgtctcctca

SEQ ID NO: 28674 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARENSSSYYFDYWGQGTLVTVSS

SEQ ID NO: 28675 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtagaagtagttactactggggctggatccgccagtccccagggaaggggctggagtggattgggagtatctattatagtgggagcaccgcctacaatccgtccctcaagagtcgagtcaccatatccgtagacacgtccaagaaccaggtctccctgaagctgagctccgtgaccgccgcagacacggctgtgtattactgtgcgagactgagcagcagctggtcttttgactactggggccagggaaccctggtcaccgtctcctca

SEQ ID NO: 28676 - protein, 119 aa, Artificial Sequence
  Description of Artificial Sequence: Synthetic polypeptide
QLQLQESGPGLVKPSETLSLTCTVSGGSISRSSYYWGWIRQSPGKGLEWIGSIYYSGSTAYNPSLKSRVTISVDTSKNQVSLKLSSVTAADTAVYYCARLSSSWSFDYWGQGTLVTVSS

SEQ ID NO: 28677 - DNA, 369 bp, Artificial Sequence
  Description of Artificial Sequence: Synthetic polynucleotide
gaggtgcagctgtcggagtctgggggaggcttggtacagcctggggggtccctgagactctcctgtgcagcctctggattcacctttagcagctatgccatgaactgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagccgaggacacggccgtatattactgtgtgaaaggggagttagtagaggactactacttctacggtatggacgtctggggccaagggaccacggtcaccgtctcctca

SEQ ID NO: 28678 - protein, 123 aa, Artificial Sequence
  Description of Artificial Sequence: Synthetic polypeptide
EVQLSESGGGLVQPGGSLRLSCAASGFTFSSYAMNWVRQAPGKGLEWVSAISGRGGSTFHADSVKGRFTISRDNSKNTLYLQMNSLRAEDTAVYYCVKGELVEDYYFYGMDVWGQGTTVTVSS

SEQ ID NO: 28679 - DNA, 351 bp, Artificial Sequence
  Description of Artificial Sequence: Synthetic polynucleotide
caggtgcagctggtgcagtctggggctgacgtgaagaagcctggggcctcagtgaaggtctcctgcaaggcttctggatacaccttcaccgactaccatatacactgggtgcgacaggcccctggacaagggcttgagtggatgggatggatcaaccctaacaatggtggcacacactatgcacaggagtttcagggcagggtcaccatgaccagggacacgtccatcagcacagcctacatggagctgagtagcctgagatctgacgacacggccgtgtattactgtgcgagagatggaactgggtcctttgactactggggccagggaaccctggtcaccgtctcctca

SEQ ID NO: 28680 - protein, 117 aa, Artificial Sequence
  Description of Artificial Sequence: Synthetic polypeptide
QVQLVQSGADVKKPGASVKVSCKASGYTFTDYHIHWVRQAPGQGLEWMGWINPNNGGTHYAQEFQGRVTMTRDTSISTAYMELSSLRSDDTAVYYCARDGTGSFDYWGQGTLVTVSS

SEQ ID NO: 28681 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggcatgatggaagtaataaatactatggagactccgtgaagggccgattcaccatctccagagacaattccaagaacacactgtatctgcaaatgaacagcctgagagccgaggacacggctgtgtattactgtgcgagagaaaatagcagctcgtactactttgactactggggccagggaaccctggtcaccgtctcctca

SEQ ID NO: 28682 - protein, 119 aa, Artificial Sequence
  Description of Artificial Sequence: Synthetic polypeptide
QVQLVESGGGVVQPGRSLRLSCAASGFTFSNYGMHWVRQAPGKGLEWVAVIWHDGSNKYYGDSVKGRFTISRDNSKNTLYLQMNSLRAEDTAVYYCARENSSSYYFDYWGQGTLVTVSS

SEQ ID NO: 28683 - DNA, 369 bp, Artificial Sequence
  Description of Artificial Sequence: Synthetic polynucleotide
gaggtgcagctgttggagtctgggggaggcttgctacagccgggggggtccctgagactctcctgtgcagcctctggattcacctttagcagctatgccatgagctgggtccgccaggctccagggaaggggctggagtgggtctcttctattagtggtcgtggtggtagcacattccacgcagactccgtgaagggccggttcaccatctccagagacaattccaagaacacgctgtatctgcaaatgaacagcctgagagccgaggacacggccgtatattactgtgtgaagggggagctacttgaggactactacttctacggtatggacgtctggggccaagggaccacggtcaccgtctcctca

SEQ ID NO: 28684 - protein, 123 aa, Artificial Sequence
  Description of Artificial Sequence: Synthetic polypeptide
EVQLLESGGGLLQPGGSLRLSCAASGFTFSSYAMSWVRQAPGKGLEWVSSISGRGGSTFHADSVKGRFTISRDNSKNTLYLQMNSLRAEDTAVYYCVKGELLEDYYFYGMDVWGQGTTVTVSS

SEQ ID NO: 28685 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctgtgccatgagctgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagccgaggacacggccgtatattactgtgtgaaaggggaactactagaggactactacttctacggtatggacgtctggggccaagggaccacggtcaccgtctcctca

SEQ ID NO: 28686 - protein, 123 aa, Artificial Sequence
  Description of Artificial Sequence: Synthetic polypeptide
EVQLLESGGGLVQPGGSLRLSCAASGFTFSSCAMSWVRQAPGKGLEWVSAISGRGGSTFHADSVKGRFTISRDNSKNTLYLQMNSLRAEDTAVYYCVKGELLEDYYFYGMDVWGQGTTVTVSS

SEQ ID NO: 28687 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttaacaactatgccatgaactgggtccgccaggctccagggaaggggctggagtgggtctcagctattagtcgtcgtggtggtagcacattctacgcagactccgtgaagggccggttcaccatctccagagacaattccaagaacactctgtatctccaaatgaacagcctgagagccgaggacacggccgtatattactgtgcgaaaggggagctactagaggactactactacttcgctatggacgtctggggccaagggaccacggtcaccgtctcctca

SEQ ID NO: 28688 - protein, 123 aa, Artificial Sequence
  Description of Artificial Sequence: Synthetic polypeptide
EVQLLESGGGLVQPGGSLRLSCAASGFTFNNYAMNWVRQAPGKGLEWVSAISRRGGSTFYADSVKGRFTISRDNSKNTLYLQMNSLRAEDTAVYYCAKGELLEDYYYFAMDVWGQGTTVTVSS

SEQ ID NO: 28689 - DNA, 375 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaggggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagatattagtaatttcagcagctggtacgattactacgctatggacgtctggggccaagggaccacggtcaccgtctcctca

SEQ ID NO: 28690 - protein, 125 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDISNFSSWYDYYAMDVWGQGTTVTVSS

SEQ ID NO: 28691 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagccgaggacacggccgtatattactgtgtgaaaggggagctactagaggactactacttctacggtatggacgtctggggccaaggggccacggtcaccgtctcctca

SEQ ID NO: 28692 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFHADSVKGRFTISRDNSKNTLYLQMNSLRAEDTAVYYCVKGELLEDYYFYGMDVWGQGATVTVSS

SEQ ID NO: 28693 - DNA, 351 bp, Artificial Sequence
  Description of Artificial Sequence: Synthetic polynucleotide
caggtgcagttggcgcagtctggggctgaggtgaagaagcctggggcctcagtgaaggtctcctgcaaggcttctggatacaccttcaccggctactatatgcactgggtgcgacaggcccctggacaagggcttgagtggatggggtggatcagccctaacaatggtggcacaaactatgcacagaagtttcagggcagggtcaccatgaccagggacacgtccatcagcacagcctacatggagctgagcaggctgagatctgacgacacggccgtgtattactgtgcgagagatggaactgggtcctttgactactggggccagggaaccctggtcaccgtctcctca

SEQ ID NO: 28694 - protein, 117 aa, Artificial Sequence
  Description of Artificial Sequence: Synthetic polypeptide
QVQLAQSGAEVKKPGASVKVSCKASGYTFTGYYMHWVRQAPGQGLEWMGWISPNNGGTNYAQKFQGRVTMTRDTSISTAYMELSRLRSDDTAVYYCARDGTGSFDYWGQGTLVTVSS

SEQ ID NO: 28695 - DNA, 360 bp, Artificial Sequence
  Description of Artificial Sequence: Synthetic polynucleotide
gaggtgcagctgttggagtctgggggagacatggtccagcctggggggtccctgagactctcctgtgcagcctccggattcacctttagcagctatgccatgagctgggtccgccaggctccagggaaggggctggagtgggtctcagttattagtggtagtggtggtagctcattctacgcagactccgtgaagggccggttcaccatctccagagacaattccaagaacacgctgtatctgcaaatgaacagcctgagggccgaggacacggccgtatattactgtgcgaaagatcgggtgagagctcatgatggttttgatatctggggccaagggacaatggtcaccgtctcttca

SEQ ID NO: 28696 - protein, 120 aa, Artificial Sequence
  Description of Artificial Sequence: Synthetic polypeptide
EVQLLESGGDMVQPGGSLRLSCAASGFTFSSYAMSWVRQAPGKGLEWVSVISGSGGSSFYADSVKGRFTISRDNSKNTLYLQMNSLRAEDTAVYYCAKDRVRAHDGFDIWGQGTMVTVSS

SEQ ID NO: 28697 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcagggcttctggatacaccttcaccgactaccatattcactgggtgcgacaggcccctggacaagggcttgagtggatgggatggatcaaccctaacaatggtggcacacactatgcacagaagtttcagggcagggtcaccatgaccagggacacgtccatcagcacagcctacatggagctgagcaggctgagatctgacgacacggccgtgtattattgtgcgagagatggaactgggtcctttgactactggggccagggaaacctggtcaccgtctcctca

SEQ ID NO: 28698 - protein, 117 aa, Artificial Sequence
  Description of Artificial Sequence: Synthetic polypeptide
QVQLVQSGAEVKKPGASVKVSCRASGYTFTDYHIHWVRQAPGQGLEWMGWINPNNGGTHYAQKFQGRVTMTRDTSISTAYMELSRLRSDDTAVYYCARDGTGSFDYWGQGNLVTVSS

SEQ ID NO: 28699 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccaggggaggggctggagtgggtctccgctattagtggtcgtggtggtagcacattctacgcagactccgtgaagggccggttcaccatctccagagacaattccaagaacacgctgtttctgcaaatgaacagcctgagagccgaggacacggccgtttattactgtgcgaaaggggagctactagaggactactactactacggtatggacgtctggggccaagggaccacggtcaccgtctcctca

SEQ ID NO: 28700 - protein, 123 aa, Artificial Sequence
  Description of Artificial Sequence: Synthetic polypeptide
EVQLLESGGGLVQPGGSLRLSCAASGFTFSSYAMNWVRQAPGEGLEWVSAISGRGGSTFYADSVKGRFTISRDNSKNTLFLQMNSLRAEDTAVYYCAKGELLEDYYYYGMDVWGQGTTVTVSS

SEQ ID NO: 28701 - DNA, 345 bp, Artificial Sequence
  Description of Artificial Sequence: Synthetic polynucleotide
gaggttcaactggtggagtctggggggggcctggtcaagcctggggggtccctgagactctcctgtgcagcctctggattcaccttcagtagttatagcatgaactgggtccgccaggctccagggaaggggctggagtgggtctcgtccattagtggtactggtagtttcatatactacgcagactcagtgaagggccgattcaccatctccagagacaacgccaagaaatcagtgtatctgcaaatgaacagcctgagagccgaggacacggctgtgtattactgtgcgagagtctctggctttgactactggggccagggaaccctggtcaccgtctcctca

SEQ ID NO: 28702 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGTGSFIYYADSVKGRFTISRDNAKKSVYLQMNSLRAEDTAVYYCARVSGFDYWGQGTLVTVSS

SEQ ID NO: 28703 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggcatgatggaagtaataaatactatgcagactccgtgaagggccgattcaccatctccagagacaattccaagaacacgctgtatctgcaaatgaacagcctgagagccgaggacacggctgtgtattactgtgcgagagaaaatagcagctcgtactactttgactactggggccagggaaccctggtcaccgtctcctca

SEQ ID NO: 28704 - protein, 119 aa, Artificial Sequence
  Description of Artificial Sequence: Synthetic polypeptide
QVQLVESGGGVVQPGRSLRLSCAASGFTFSNYGMHWVRQAPGKGLEWVAVIWHDGSNKYYADSVKGRFTISRDNSKNTLYLQMNSLRAEDTAVYYCARENSSSYYFDYWGQGTLVTVSS

SEQ ID NO: 28705 - DNA, 369 bp, Artificial Sequence
  Description of Artificial Sequence: Synthetic polynucleotide
gaggttcaattgttggagtctgggggaggcttggtacagcctggggggtccctgagactctcctgtgcagcctctggattcacctttagcaactatgccatgagctgggtccgccaggctccagggaaggggctggagtgggtctcagctattagtcgtcgtggtggtagcacattctacgcagactccgtgaagggccagttcaccatttccagagacaattccaagaacacgctgtatctgcaaatgaacagcctgagagccgaggacacggccgtgtattactgtgcgaaaggggagctactagaggactactcctactacggtatggacgtctggggccaggggaccacggtcaccgtctcctca

SEQ ID NO: 28706 - protein, 123 aa, Artificial Sequence
  Description of Artificial Sequence: Synthetic polypeptide
EVQLLESGGGLVQPGGSLRLSCAASGFTFSNYAMSWVRQAPGKGLEWVSAISRRGGSTFYADSVKGQFTISRDNSKNTLYLQMNSLRAEDTAVYYCAKGELLEDYSYYGMDVWGQGTTVTVSS

SEQ ID NO: 28707 - DNA, 369 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaacaacacgctgtatctgcaaatgaacagcctgagagccgaggacacggccgtatattactgtgtgaaaggggagttactagaggactactacttctacggtatggacgtctggggccaaggggccacggtcaccgtctcctca

SEQ ID NO: 28708 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFHADSVKGRFTISRDNSNNTLYLQMNSLRAEDTAVYYCVKGELLEDYYFYGMDVWGQGATVTVSS

SEQ ID NO: 28709 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccatgaagggccggttcaccatctccagagacaattccaagaacacgctgtatctgcaaatgaacagcctgagagccgaggacacggccgtatattactgtgtgaaaggggagctactagaggactactacttctacggtatggacgtctggggccaagggaccacggtcaccgtctcctca

SEQ ID NO: 28710 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFHADSMKGRFTISRDNSKNTLYLQMNSLRAEDTAVYYCVKGELLEDYYFYGMDVWGQGTTVTVSS

SEQ ID NO: 28711 - DNA, 342 bp, Artificial Sequence
  Description of Artificial Sequence: Synthetic polynucleotide
gaggtgcaactggtggagtctgggggaggcctggtcaagccgggggggtccctgagactctcctgtgcagcctctggattcaccttcagtagctataccatgaactgggtccgccaggctccagggaaggggctgcagtgggtctcatccattagtggtagtagtagttacatatactacgcggactcagtgaagggccgattcaccatctccagagacaacgccaagaactcactgtttctgcaaatgaacagcctgagagccgaggacacggctatcttttactgtgcgcgagatcggggggggacctggggccagggaaccctggtcaccgtctcctca

SEQ ID NO: 28712 - protein, 114 aa, Artificial Sequence
  Description of Artificial Sequence: Synthetic polypeptide
EVQLVESGGGLVKPGGSLRLSCAASGFTFSSYTMNWVRQAPGKGLQWVSSISGSSSYIYYADSVKGRFTISRDNAKNSLFLQMNSLRAEDTAIFYCARDRGGTWGQGTLVTVSS

SEQ ID NO: 28713 - DNA, 351 bp, Artificial Sequence
  Description of Artificial Sequence: Synthetic polynucleotide
caggtgcagctggtgcagtctggggctgacgtgaagaagcctggggcctcagtgaaggtctcctgcaaggcttctggatacaccttcaccgactaccatatacactgggtgcgacaggcccctggacaagggcttgagtggatgggatggatcaaccctaacaatggtggcacacactatgcacaggagtttcagggcagggtcaccatgaccagggacacgtccatcagcacagcctacatggaactgagtagcctgagatctgacgacacggccgtgtatcactgtgcgagagatggaactgggtcctttgactactggggccagggaaccctggtcaccgtctcctca

SEQ ID NO: 28714 - protein, 117 aa, Artificial Sequence
  Description of Artificial Sequence: Synthetic polypeptide
QVQLVQSGADVKKPGASVKVSCKASGYTFTDYHIHWVRQAPGQGLEWMGWINPNNGGTHYAQEFQGRVTMTRDTSISTAYMELSSLRSDDTAVYHCARDGTGSFDYWGQGTLVTVSS

SEQ ID NO: 28715 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatgtcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaaatagcagctcgtactactttgactactggggccagggaaccctggtcaccgtctcctca

SEQ ID NO: 28716 - protein, 119 aa, Artificial Sequence
  Description of Artificial Sequence: Synthetic polypeptide
QVQLVESGGGVVQPGRSLRLSCAASGFTFSNYVMHWVRQAPGKGLEWVALIWYDGSNKYYADSVKGRFTISRDNSKNTLYLQMNSLRAEDTAVYYCARENSSSYYFDYWGQGTLVTVSS

SEQ ID NO: 28717 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaaatagcagctcgtactactttgactactggggccagggaaccctggtcaccgtctcctca

SEQ ID NO: 28718 - protein, 119 aa, Artificial Sequence
  Description of Artificial Sequence: Synthetic polypeptide
QVQLVESGGGVVQPGRSLRLSCAASGFTFSNYGMHWVRQAPGKGLEWVAVIWYDGSNKYYADSVKGRFTISRDNSKNTLYLQMNSLRAEDTAVYYCARENSSSYYFDYWGQGTLVTVSS

SEQ ID NO: 28719 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatggtggaagtaataaatactatgcagactccgtgaagggccgattcaccatctccagagacaattccaagaacacgctgtatctgcaaatgaacagcctgagagctgaggacacggctgtgtattactgtgtgagaagggggtatagcagtggaggctacggtatggacgtctggggccaagggaccacggtcaccgtctcctca

SEQ ID NO: 28720 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYGGSNKYYADSVKGRFTISRDNSKNTLYLQMNSLRAEDTAVYYCVRRGYSSGGYGMDVWGQGTTVTVSS

SEQ ID NO: 28721 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactactatatacactgggtgcgacaggcccctggacaagggcttgagtggatgggatggatcaaccctaataggggtggcacaaactatgcacagaagtttcagggcagggtcaccatgaccagggacacgtccatcagcacagcctacatggaactgagcaggctgagatctgacgacacggccgtgtattactgtgcgagagatggaactgggtcctttgactactggggccagggaaccctggtcaccgtctcctca

SEQ ID NO: 28722 - protein, 117 aa, Artificial Sequence
  Description of Artificial Sequence: Synthetic polypeptide
QVQLVQSGAEVKKPGASVKVSCKASGYTFTDYYIHWVRQAPGQGLEWMGWINPNRGGTNYAQKFQGRVTMTRDTSISTAYMELSRLRSDDTAVYYCARDGTGSFDYWGQGTLVTVSS

SEQ ID NO: 28723 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatggcatgaactgggtccgccaggctccagggaaggggctggagtgggtctcatccattagtggtagtagtacttacatatactacgcagactcagtgaagggccgattcaccatctccagagacaacgccaagaactcactgtatctgcaaatgaacagcctgagagccgaggacacggctgtgtattactgtgcgagaacaaacggtatggacgtctggggccaagggaccacggtcaccgtctcctca

SEQ ID NO: 28724 - protein, 115 aa, Artificial Sequence
  Description of Artificial Sequence: Synthetic polypeptide
EVQLVESGGGLVKPGGSLRLSCAASGFTFSSYGMNWVRQAPGKGLEWVSSISGSSTYIYYADSVKGRFTISRDNAKNSLYLQMNSLRAEDTAVYYCARTNGMDVWGQGTTVTVSS

SEQ ID NO: 28725 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgacattaactgggtgcgacaggccactggacaagggcttgagtgggtgggatggctgcaccctaacagtggtaccacaggctttgcacagaagttccggggcagagtcaccatgaccagaaacacctccataagcacagcctacttggaactgagcagcctgagatctgaggacacggccgtgtattactgtgcgagcagcagtggctggtacttttttgactactggggccagggaaccctggtcaccgtctcctca

SEQ ID NO: 28726 - protein, 118 aa, Artificial Sequence
  Description of Artificial Sequence: Synthetic polypeptide
QVQLVQSGAEVKKPGASVKVSCKASGYTFTNYDINWVRQATGQGLEWVGWLHPNSGTTGFAQKFRGRVTMTRNTSISTAYLELSSLRSEDTAVYYCASSSGWYFFDYWGQGTLVTVSS

SEQ ID NO: 28727 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaagaacacgctgtatctgcaaattaacagcctgagagccgaggacacggccgtatattactgtgtgaaaggggagctactagaggactactacttctacggtatggacgtctggggccaagggaccacggtcaccgtctcctca

SEQ ID NO: 28728 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFHADSVKGRFTISRDNSKNTLYLQINSLRAEDTAVYYCVKGELLEDYYFYGMDVWGQGTTVTVSS

SEQ ID NO: 28729 - DNA, 345 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaaagaagtctaacgactactggggccagggaaccctggtcaccgtctcctca

SEQ ID NO: 28730 - protein, 115 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARKKSNDYWGQGTLVTVSS

SEQ ID NO: 28731 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttaacaactatgccatgaactgggtccgccaggctccagggaaggggctggagtgggtctcagctattagtcgtcgtggtggtaacacattctacgcagactccgtgaagggccggttcaccatctccagagacaattccaagaacacgctgtatctccaaatgaacagcctgagagccgaggacacggccgtatattactgtgcgaaaggggagctactagaggactactactactacgctatggacgtctggggccaagggaccacggtcaccgtctcctca

SEQ ID NO: 28732 - protein, 123 aa, Artificial Sequence
  Description of Artificial Sequence: Synthetic polypeptide
EVQLLESGGGLVQPGGSLRLSCAASGFTFNNYAMNWVRQAPGKGLEWVSAISRRGGNTFYADSVKGRFTISRDNSKNTLYLQMNSLRAEDTAVYYCAKGELLEDYYYYAMDVWGQGTTVTVSS

SEQ ID NO: 28733 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagcagctatggcatgcactgggtccgccaggctccaggcaaggggctggagtgggtggcagttatatggtatgatggaagtaataaatattatgcagactccgtgaagggccgattcaccatctccagagacaattccaagaacacgctatatctacaaatgaacagcctgagagccgaggacacggctgtgtattactgtgcgagagattcctccccctacggtatggacgtctggggccaagggaccacggtcaccgtctcctca

SEQ ID NO: 28734 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDSSPYGMDVWGQGTTVTVSS

SEQ ID NO: 28735 - DNA, 390 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtggctatggcatgcactgggtccgccaggctccaggcaaggggctggagtgggtggcaattatatggtatgatggaagtaaaaaatacaatgcagactccgtgaagggccgattcaccatctccagagacaattccaagaacacgctgtatctgcaaatgaacagcctgagagccgaggacacggctgtgtattactgtgcgagagatagggtatattgtagtagtaccagctgctccccttactactactactacggtatggacgtctggggccaagggaccacggtcaccgtctcctca

SEQ ID NO: 28736 - protein, 130 aa, Artificial Sequence
  Description of Artificial Sequence: Synthetic polypeptide
QVQLVESGGGVVQPGRSLRLSCAASGFTFSGYGMHWVRQAPGKGLEWVAIIWYDGSKKYNADSVKGRFTISRDNSKNTLYLQMNSLRAEDTAVYYCARDRVYCSSTSCSPYYYYYGMDVWGQGTTVTVSS

SEQ ID NO: 28737 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtgatggcactaactatgcacagaagtttcagggcagggtcaccatgaccagggacacgtccatcagcacagcctacatggagctgaacaggctgagatctgacgacacggccgtgtattactgtgcgagggggttttactatggttcggggagttattataacgacctcgacccctggggccagggaaccctggtcaccgtctcctca

SEQ ID NO: 28738 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSDGTNYAQKFQGRVTMTRDTSISTAYMELNRLRSDDTAVYYCARGFYYGSGSYYNDLDPWGQGTLVTVSS

SEQ ID NO: 28739 - DNA, 369 bp, Artificial Sequence
  Description of Artificial Sequence: Synthetic polynucleotide
caggtgcacctggtggagtctgggggaggcgtggtccagcctgggaggtccctgagactctcctgtgcagcctctggattcaccttcagttactatggcatgcactgggtccgccaggctccaggcaaggggctggagtgggtggcagttatatcatatgatggaagtaataaatactatgcagactccgtgaagggccgattcaccatctccagagacaattccaagaacacgctgcatctgcaaatgaacagcctgagagctgaggacacggctgtgtattactgtgcgagagatcggagggggggctatggagtccccgatgcttttgatatctggggccaagggacaatggtcaccgtctcttca

SEQ ID NO: 28740 - protein, 123 aa, Artificial Sequence
  Description of Artificial Sequence: Synthetic polypeptide
QVHLVESGGGVVQPGRSLRLSCAASGFTFSYYGMHWVRQAPGKGLEWVAVISYDGSNKYYADSVKGRFTISRDNSKNTLHLQMNSLRAEDTAVYYCARDRRGGYGVPDAFDIWGQGTMVTVSS

SEQ ID NO: 28741 - DNA, 390 bp, Artificial Sequence
  Description of Artificial Sequence: Synthetic polynucleotide
caggtgcagttggtggagtctgggggaggcgtggtccagactgggaggtccctgagactctcctgtgcagcctctggattcaccttcagtggctatggcatgcactgggtccgccaggctccaggcaaggggctggagtgggtgtcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatcgggtctattgtagtagtaccagctgcgtcccttactacgactactacggtatggacgtctggggccaagggaccacggtcaccgtctcctca

SEQ ID NO: 28742 - protein, 130 aa, Artificial Sequence
  Description of Artificial Sequence: Synthetic polypeptide
QVQLVESGGGVVQTGRSLRLSCAASGFTFSGYGMHWVRQAPGKGLEWVSVISYDGSNKYYADSVKGRFTISRDNSKNTLYLQMNSLRAEDTAVYYCARDRVYCSSTSCVPYYDYYGMDVWGQGTTVTVSS

SEQ ID NO: 28743 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggattcctattgtagtagtaccagctgcccttactactactactacggtatggacgtctggggccaagggaccacggtcaccgtctcctca

SEQ ID NO: 28744 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREDSYCSSTSCPYYYYYGMDVWGQGTTVTVSS

SEQ ID NO: 28745 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagggggtattactatggttcggggagttattataacgacctcgacccctggggtcagggaaccctggtcaccgtctcctca

SEQ ID NO: 28746 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYYYGSGSYYNDLDPWGQGTLVTVSS

SEQ ID NO: 28747 - DNA, 372 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagcagctatgccatgagctgggtccgccaggctccagggaaggggctggagtgggtctcaactcttagtggtcgtggtggtagcacatactacgcagactccgtgaagggccggtccaccatctccagagacaattccaagaacacgctgtatctgcaaatgagcagcctgagagccgaggacacggccgtatattactgtgcgaaatggggacgtggatacagctatgagtactactacggtatggacgtctggggccaagggaccacggtcaccgtctcctca

SEQ ID NO: 28748 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSTLSGRGGSTYYADSVKGRSTISRDNSKNTLYLQMSSLRAEDTAVYYCAKWGRGYSYEYYYGMDVWGQGTTVTVSS

SEQ ID NO: 28749 - DNA, 372 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactctgcacagaagtttcagggcagggtcaccatgaccagggacacgtccatcagcacagcctacatggagctgagcaggctgagatctgacgacacggccgtatattactgtgcgaggtcctattactatggttcggggagttattataacgagtttgactactggggccagggaaccctggtcaccgtctcctca

SEQ ID NO: 28750 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNSAQKFQGRVTMTRDTSISTAYMELSRLRSDDTAVYYCARSYYYGSGSYYNEFDYWGQGTLVTVSS

SEQ ID NO: 28751 - DNA, 354 bp, Artificial Sequence
  Description of Artificial Sequence: Synthetic polynucleotide
cagatcaccttgaaggagtctggtcttacgctgatgaaacccacacagaccctcacgctgacctgcaccttctctgggttctcactcagcactggtggagtgggtgtgggctggatccgtcagcccccaggaaaggccctggagtggcttgcactcatttattggcatgatgataagcgctacagtccatctctgaggagcaggctcaccatcaccaaggacacctccaaaaaccaggtggtccttacaatgaccaacatggaccctgtggacacagccacatattactgtgcacgtatagtagcagttgcctttgactactggggccagggaaccctgatcaccgtctcctca

SEQ ID NO: 28752 - protein, 118 aa, Artificial Sequence
  Description of Artificial Sequence: Synthetic polypeptide
QITLKESGLTLMKPTQTLTLTCTFSGFSLSTGGVGVGWIRQPPGKALEWLALIYWHDDKRYSPSLRSRLTITKDTSKNQVVLTMTNMDPVDTATYYCARIVAVAFDYWGQGTLITVSS

SEQ ID NO: 28753 - DNA, 387 bp, Artificial Sequence
  Description of Artificial Sequence: Synthetic polynucleotide
caggtgcagttggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaagtatgcacagaagtttcagggcagggtcaccatgaccagggacacgtccatcagcacagcctacatggagctgaacaggctgagatctgacgacacggccgtgtattactgtgcgagagagaggtgtagtactaccagttgctatttaggaattacgggctactacggtatggacgtctggggccaagggaccacggtcaccgtctcctca

SEQ ID NO: 28754 - protein, 129 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTKYAQKFQGRVTMTRDTSISTAYMELNRLRSDDTAVYYCARERCSTTSCYLGITGYYGMDVWGQGTTVTVSS

SEQ ID NO: 28755 - DNA, 354 bp, Artificial Sequence
  Description of Artificial Sequence: Synthetic polynucleotide
cagatcaccttgagggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagcccatctctgaagagcagactcaccatcaccaaggacacctccaaaaaccaggtggtccttacaatgaccaacatggaccctgtggacacagccacatattactgtgcacacttaatagcagtgacttttgactcctggggccagggatccctggtcaccgtctcctca

SEQ ID NO: 28756 - protein, 118 aa, Artificial Sequence
  Description of Artificial Sequence: Synthetic polypeptide
QITLRESGPTLVKPTQTLTLTCTFSGFSLSTSGVGVGWIRQPPGKALEWLALIYWNDDKRYSPSLKSRLTITKDTSKNQVVLTMTNMDPVDTATYYCAHLIAVTFDSWGQGSLVTVSS

SEQ ID NO: 28757 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggaatgatggaagtaataaatactatgcagactccgtgaagggccgattcaccatctccagagacaattccaagaacacgctgtatctgcaaatgaacagcctgagagccgaggacacggctgtgtattactgtgcgagagatcgggtagcagcagctggtaccccctactactactacggtatggacgtctggggccaagggaccacggtcaccgtctcctca

SEQ ID NO: 28758 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVIWNDGSNKYYADSVKGRFTISRDNSKNTLYLQMNSLRAEDTAVYYCARDRVAAAGTPYYYYGMDVWGQGTTVTVSS

SEQ ID NO: 28759 - DNA, 390 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgcacagcctgaaaaccgaggacacagccgtgtattactgtaccacagatacgggtcctatagcagctcgtctcgcttactactactactacgctatggacgtctggggccaagggaccacggtcaccgtctcctca

SEQ ID NO: 28760 - protein, 130 aa, Artificial Sequence
  Description of Artificial Sequence: Synthetic polypeptide
EVQLVESGGGLVKPGGSLRLSCAASGFTFSNAWMNWVRQAPGKGLEWVGRIKSKTDGGTTDYAAPVKGRFTISRDDSKNTLYLQMHSLKTEDTAVYYCTTDTGPIAARLAYYYYYAMDVWGQGTTVTVSS

SEQ ID NO: 28761 - DNA, 384 bp, Artificial Sequence
  Description of Artificial Sequence: Synthetic polynucleotide
gaggtgcagctgttggagtctgggggaggcttggtacagcctgaggggtccctgagactctcctgtgcagcctctggattcacctttagcagctatgccatgagctgggtccgccaggctccagggaaggggctggagtgggtctcaggtattagtggtagtggtggtagcacatactacgcagactccgtgaagggccggttcaccatctccagagacaattccaagaacacgctgtgtctgcacatgaacagcctgagagccgaggacacggccgtatattactgtgcgaaagaatattgtggtggtgactgctattccccttactactactactacggtatggacgtctggggccaagggaccacggtcaccgtctcctca

SEQ ID NO: 28762 - protein, 128 aa, Artificial Sequence
  Description of Artificial Sequence: Synthetic polypeptide
EVQLLESGGGLVQPEGSLRLSCAASGFTFSSYAMSWVRQAPGKGLEWVSGISGSGGSTYYADSVKGRFTISRDNSKNTLCLHMNSLRAEDTAVYYCAKEYCGGDCYSPYYYYYGMDVWGQGTTVTVSS

SEQ ID NO: 28763 - DNA, 390 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtggctatggcctgcactgggtccgccaggctccaggcaaggggctggagtgggtggcacttatatggtatgatggaaataatacatactatgcagactccgtgaagggccgattcaccatctccagagacaattccaagaacacgctgtatctgcaaatgaacagcctgagagccgaagacacggctgtgtattactgtgcgagagatagggtatattgtagtagtaccagctgctccccttactactactactacggtatggacgtctggggccaagggaccacggtcaccgtctcctca

SEQ ID NO: 28764 - protein, 130 aa, Artificial Sequence
  Description of Artificial Sequence: Synthetic polypeptide
QVQLVESGGGVVQPGRSLRLSCAASGFTFSGYGLHWVRQAPGKGLEWVALIWYDGNNTYYADSVKGRFTISRDNSKNTLYLQMNSLRAEDTAVYYCARDRVYCSSTSCSPYYYYYGMDVWGQGTTVTVSS

SEQ ID NO: 28765 - DNA, 372 bp, Artificial Sequence
  Description of Artificial Sequence: Synthetic polynucleotide
caggtgaagctggtgcagtctggggctgaggtgaagaagcctggggcctcagtgaaggtctcctgcaaggcttcaggatacaccttcaccggctactatatgcactgggtgcgacaggcccctggacaagggcttgagtggatgggatggatcaaccctaaaagtggtggcacaaattatgcacagaagtttcagggcagggtcaccatgaccagggacacgtccatcagcacagtctacatggagccgagcaggctgagatctgacgacacggccgtgtattactgtgcgagagtgtattaccatggttcggggagttattataacgagtttgattattggggccagggaaccctggtcaccgtctcctca

SEQ ID NO: 28766 - protein, 124 aa, Artificial Sequence
  Description of Artificial Sequence: Synthetic polypeptide
QVKLVQSGAEVKKPGASVKVSCKASGYTFTGYYMHWVRQAPGQGLEWMGWINPKSGGTNYAQKFQGRVTMTRDTSISTVYMEPSRLRSDDTAVYYCARVYYHGSGSYYNEFDYWGQGTLVTVSS

SEQ ID NO: 28767 - DNA, 384 bp, Artificial Sequence
  Description of Artificial Sequence: Synthetic polynucleotide
gaggtgcagctgttggagtctgggggaggcttggtacagcctgaggggtccctgagactctcctgtgcagcctctggattcacctttagcagctatgccatgagctgggtccgccaggctccagggaaggggctggagtgggtctcagctattagtggtagtggtagtagcacatactacgcagactccgtgaagggccggttcaccatctccagagacaattccaagaacacgctgtgtctgcaaatgaacagcctgagagccgaggacacggccgtatattactgtgcgaaagaatattgtggtggtgactgctattccccttactactactactacggtatggacgtctggggccaagggaccacggtcaccgtctcctca

SEQ ID NO: 28768 - protein, 128 aa, Artificial Sequence
  Description of Artificial Sequence: Synthetic polypeptide
EVQLLESGGGLVQPEGSLRLSCAASGFTFSSYAMSWVRQAPGKGLEWVSAISGSGSSTYYADSVKGRFTISRDNSKNTLCLQMNSLRAEDTAVYYCAKEYCGGDCYSPYYYYYGMDVWGQGTTVTVSS

SEQ ID NO: 28769 - DNA, 390 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcggtagctatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgggtatcttgtagtagttccagctgctatccttactactactactacggtatggacgtctggggccaagggaccacggtcaccgtctcctca

SEQ ID NO: 28770 - protein, 130 aa, Artificial Sequence
  Description of Artificial Sequence: Synthetic polypeptide
QVQLVESGGGVVQPGRSLRLSCAASGFTFGSYGMHWVRQAPGKGLEWVALIWYDGSNKYYADSVKGRFTISRDNSKNTLYLQMNSLRAEDTAVYYCARDRVSCSSSSCYPYYYYYGMDVWGQGTTVTVSS

SEQ ID NO: 28771 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcgcaaactatgcacagaagtttcagggcagggtcaccatgaccagggacacgtccatcagcacagcctacatggagctgagcaggctgagatctgacgacacggccgtgtatttctgtgcgaggtcgttttactatggttcggggacttattataacgagtttgactactggggccagggaaccctggtcaccgtctcctca

SEQ ID NO: 28772 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGANYAQKFQGRVTMTRDTSISTAYMELSRLRSDDTAVYFCARSFYYGSGTYYNEFDYWGQGTLVTVSS

SEQ ID NO: 28773 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgggcactatatgcactgggtgcgacaggcccctggacaaggacttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgaggtcgtattactatggttcggggacttattataacgagtttgactactggggccagggaaccctggtcaccgtctcctca

SEQ ID NO: 28774 - protein, 124 aa, Artificial Sequence
  Description of Artificial Sequence: Synthetic polypeptide
QVQLVQSGAEVKKPGASVKVSCKASGYTFTGHYMHWVRQAPGQGLEWMGWINPNSGGTNYAQKFQGRVTMTRDTSISTAYMELSRLRSDDTAVYYCARSYYYGSGTYYNEFDYWGQGTLVTVSS

SEQ ID NO: 28775 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatcggacgacacggccgtgtattactgtgcgagagcgaattactatggttcggggagttattataacgactttgactactggggccagggaaccctggtcaccgtctcctca

SEQ ID NO: 28776 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARANYYGSGSYYNDFDYWGQGTLVTVSS

SEQ ID NO: 28777 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctggattctcactcagcactggtggagtgggtgtgggctggatccgtcagcccccaggaaaggccctggagtggcttgcactcatttattggcatgatgataagcgctacagtccctctctgaagagcaggctcgccatcaccaaggacacctccaaaaaccaggtggtccttacaattaccaacatggaccctgtggacacagccacatattactgtgctcacttaatagcagtggcttttgactattggggccagggaaccctggtcaccgtctcctca

SEQ ID NO: 28778 - protein, 118 aa, Artificial Sequence
  Description of Artificial Sequence: Synthetic polypeptide
QITLKESGPTLVKPTQTLTLTCTFSGFSLSTGGVGVGWIRQPPGKALEWLALIYWHDDKRYSPSLKSRLAITKDTSKNQVVLTITNMDPVDTATYYCAHLIAVAFDYWGQGTLVTVSS

SEQ ID NO: 28779 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcagcggctactatatgcactgggtgcgacaggcccctggacaaggacttgagtggatgggatggatcaaccctaacaatggtggcacacactatgcacagaagtttcagggcagggtcaccatgaccagggacacgtccatccgcacagcctccatggagctgagcaggctgagatctgacgacacggccgtgtatttctgtgcgaggggatattattatgcttcggggagttattataacgacctcgacccctggggccagggaaccctggtcaccgtctcctca

SEQ ID NO: 28780 - protein, 124 aa, Artificial Sequence
  Description of Artificial Sequence: Synthetic polypeptide
QVQLVQSGAEVKKPGASVKVSCKASGYTFSGYYMHWVRQAPGQGLEWMGWINPNNGGTHYAQKFQGRVTMTRDTSIRTASMELSRLRSDDTAVYFCARGYYYASGSYYNDLDPWGQGTLVTVSS

SEQ ID NO: 28781 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgtactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtttattactgtgcgaggtcgtatttttatggttcggggagttattataacgagtttgactactggggccagggaaccctggtcaccgtctcctca

SEQ ID NO: 28782 - protein, 124 aa, Artificial Sequence
  Description of Artificial Sequence: Synthetic polypeptide
QVQLVQSGAEVKKPGASVKVSCKASGYTFTGYYMYWVRQAPGQGLEWMGWINPNSGGTNYAQKFQGRVTMTRDTSISTAYMELSRLRSDDTAVYYCARSYFYGSGSYYNEFDYWGQGTLVTVSS

SEQ ID NO: 28783 - DNA, 354 bp, Artificial Sequence
  Description of Artificial Sequence: Synthetic polynucleotide
cagatcaccttgaaggagtctggtccttcgctggtgaagcccacacagaccctcacgctgacctgcaccttctctggattctcactcagcactagtggagtgggtgtgggctggatccgtcagccccccggaaaggccctggagtggcttgcactcatttattgggatgatgataagcgctacagcccatctctgaagagcaggctcaccatcaccaaggacacctccaaaaaccaggtggtcctgacaatgaccaacatggaccctgtggacacagccacatattcctgtgcacacattatagcagtggcttttgactactggggccagggaaccctggtcaccgtctcctca

SEQ ID NO: 28784 - protein, 118 aa, Artificial Sequence
  Description of Artificial Sequence: Synthetic polypeptide
QITLKESGPSLVKPTQTLTLTCTFSGFSLSTSGVGVGWIRQPPGKALEWLALIYWDDDKRYSPSLKSRLTITKDTSKNQVVLTMTNMDPVDTATYSCAHIIAVAFDYWGQGTLVTVSS

SEQ ID NO: 28785 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctccctcaacactggtggagtgggtgtgggctggatccgtcagcccccaggaaaggccctggagtggcttgcactcatttattggaatgatgatgagcgctacagcccatctctgaagagcaggctcaccatcaccaaggacacctccaaaaaccaggtggtccttacaatgaccaacatggaccctttggacacagcctcatattactgtgcacacttaatagcagtttcctttgactactggggccagggagccctggtcaccgtctcctca

SEQ ID NO: 28786 - protein, 118 aa, Artificial Sequence
  Description of Artificial Sequence: Synthetic polypeptide
QITLKESGPTLVKPTQTLTLTCTFSGFSLNTGGVGVGWIRQPPGKALEWLALIYWNDDERYSPSLKSRLTITKDTSKNQVVLTMTNMDPLDTASYYCAHLIAVSFDYWGQGALVTVSS

SEQ ID NO: 28787 - DNA, 372 bp, Artificial Sequence
  Description of Artificial Sequence: Synthetic polynucleotide
caggtgaagctggtgcagtctggggctgaggtgaagaagcctggggcctcagtgaaggtctcctgcaaggcttcaggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagtgtattactatggttcggggagttattataacgagtttgactactggggccagggaaccctggtcaccgtctcctca

SEQ ID NO: 28788 - protein, 124 aa, Artificial Sequence
  Description of Artificial Sequence: Synthetic polypeptide
QVKLVQSGAEVKKPGASVKVSCKASGYTFTGYYMHWVRQAPGQGLEWMGWINPNSGGTNYAQKFQGRVTMTRDTSISTAYMELSRLRSDDTAVYYCARVYYYGSGSYYNEFDYWGQGTLVTVSS

SEQ ID NO: 28789 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaaggacttgagtggatgggatggatcaaccctaacagtggtggcacagactatgcacagaagtttcagggcagggtcaccatgaccagggacacgtccatcagcacagcctacatggagctgagcaggctgagatctgacgacacggccgtgtattactgtgcgaggtcgtattactatggttcggggacttattataacgagtttgactactggggccagggaaccctggtcaccgtctcctca

SEQ ID NO: 28790 - protein, 124 aa, Artificial Sequence
  Description of Artificial Sequence: Synthetic polypeptide
QVQLVQSGAEVKKPGASVKVSCKASGYTFTGYYIHWVRQAPGQGLEWMGWINPNSGGTDYAQKFQGRVTMTRDTSISTAYMELSRLRSDDTAVYYCARSYYYGSGTYYNEFDYWGQGTLVTVSS

SEQ ID NO: 28791 - DNA, 372 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttagcagctatgccatgagctgggtccgccaggctccagggaaggggctggagtgggtctcagctattagtggtggtggtggtagcacatactacgcagactccgtgaagggccgggtcaccatctccagagacaattccaagaacacgctgtatctgcaaatgaacagcctgagagccgaggacacggccgtatattactgtgcgaaatggggacgtggatacaactatgagtactactacggtatggacgtctggggccaagggaccacggtcaccgtctcctca

SEQ ID NO: 28792 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGGGGSTYYADSVKGRVTISRDNSKNTLYLQMNSLRAEDTAVYYCAKWGRGYNYEYYYGMDVWGQGTTVTVSS

SEQ ID NO: 28793 - DNA, 387 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatgtgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagagaggtgtagtactaccagctgctatttaggaattacgggctactacggtatggacgtctggggccaagggaccacggtcaccgtctcctca

SEQ ID NO: 28794 - protein, 129 aa, Artificial Sequence
  Description of Artificial Sequence: Synthetic polypeptide
QVQLVQSGAEVKKPGASVKVSCKASGYTFTGYYVHWVRQAPGQGLEWMGWINPNSGGTNYAQKFQGRVTMTRDTSISTAYMELSRLRSDDTAVYYCARERCSTTSCYLGITGYYGMDVWGQGTTVTVSS

SEQ ID NO: 28795 - DNA, 384 bp, Artificial Sequence
  Description of Artificial Sequence: Synthetic polynucleotide
gaggtgcagctgttggagtctgggggaggcttggtacagcctgaggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtgtctgcaaatgaacagcctgagagccgaggacacggccgtatattactgtgcgaaagaatattgtggtggtgactgctattccccttactactactactacggtatggacgtctggggccaagggaccacggtcaccgtctcctca

SEQ ID NO: 28796 - protein, 128 aa, Artificial Sequence
  Description of Artificial Sequence: Synthetic polypeptide
EVQLLESGGGLVQPEGSLRLSCAASGFTFSSYAMSWVRQAPGKGLEWVSAISGSGGSTYYADSVKGRFTISRDNSKNTLCLQMNSLRAEDTAVYYCAKEYCGGDCYSPYYYYYGMDVWGQGTTVTVSS

SEQ ID NO: 28797 - DNA, 354 bp, Artificial Sequence
  Description of Artificial Sequence: Synthetic polynucleotide
caggtgcagctggtgcagtctggggctgaggtgcagaagcctggggcctcagtgaaggtctcctgcaaggcttctggatacaccttcaccaattatgatatcaactgggtgcgacaggccactggacaagggcttgagtggatgggctggatgaaccctaacagtggtaacacaggctatgcacagaggttccagggcagagtcaccatgaccaggaacacctccataagcgcagcctacatggagctgagcagcctgagatctgaggacacggccgtatattactgtgcgagtagcagtggctggtactactttgactactggggccagggaaccctggtcaccgtctcctca

SEQ ID NO: 28798 - protein, 118 aa, Artificial Sequence
  Description of Artificial Sequence: Synthetic polypeptide
QVQLVQSGAEVQKPGASVKVSCKASGYTFTNYDINWVRQATGQGLEWMGWMNPNSGNTGYAQRFQGRVTMTRNTSISAAYMELSSLRSEDTAVYYCASSSGWYYFDYWGQGTLVTVSS

SEQ ID NO: 28799 - DNA, 372 bp, Artificial Sequence
  Description of Artificial Sequence: Synthetic polynucleotide
caggtgaaactggtgcagtctggggctgaggtgaagaagcctggggcctcagtgaaggtctcctgcaaggcttcaggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagtgtatttctatggttcggggagttattataacgagtttgactactggggccagggaaccctggtcaccgtctcctca

SEQ ID NO: 28800 - protein, 124 aa, Artificial Sequence
  Description of Artificial Sequence: Synthetic polypeptide
QVKLVQSGAEVKKPGASVKVSCKASGYTFTGYYMHWVRQAPGQGLEWMGWINPNSGGTNYAQKFQGRVTMTRDTSISTAYMELSRLRSDDTAVYYCARVYFYGSGSYYNEFDYWGQGTLVTVSS

SEQ ID NO: 28801 - DNA, 354 bp, Artificial Sequence
  Description of Artificial Sequence: Synthetic polynucleotide
gaggtgcagctggtggagtctgggggaggcttggtaaagcctggggggtcccttagactctcctgtgcagcctctggagtcactttcagtaccgcctggatgaactgggtccgccaggctccagggaaggggctggagtgggttggccggattaaaaacaaaattgatggtgggacaacagactacgttgcacccgtgaaaggcagattcaccatctcaagagatgattcaaaaaacacgctgtatctgcaaatgaacagcctgaaaaccgaggacacagccgtatattactgtaccacagaaggctggaacacggactactggggccagggaaccctggtcaccgtctcctca

SEQ ID NO: 28802 - protein, 118 aa, Artificial Sequence
  Description of Artificial Sequence: Synthetic polypeptide
EVQLVESGGGLVKPGGSLRLSCAASGVTFSTAWMNWVRQAPGKGLEWVGRIKNKIDGGTTDYVAPVKGRFTISRDDSKNTLYLQMNSLKTEDTAVYYCTTEGWNTDYWGQGTLVTVSS

SEQ ID NO: 28803 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcaacagaagtagttattactggggctggatccgccagcccccagggaaggggctggagtggattgggaatatctattatagtgggaccacctactacaacccgtccctcaagagtcgagtcaccatatccgtagacacgtccaagaaccagttctccctgaacctgagctctgtgaccgccgcagacacggctgtatattcctgtgcgagacatggaaaagactggggccttgactactggggccagggaaccctggtcaccgtctcctca

SEQ ID NO: 28804 - protein, 119 aa, Artificial Sequence
  Description of Artificial Sequence: Synthetic polypeptide
QLQLQESGPGLVKPSETLSLTCTVSGGSINRSSYYWGWIRQPPGKGLEWIGNIYYSGTTYYNPSLKSRVTISVDTSKNQFSLNLSSVTAADTAVYSCARHGKDWGLDYWGQGTLVTVSS

SEQ ID NO: 28805 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaaggggctggagtggattgggaatatctattatagtgggatcccctactacaacccgtccctcaagagtcgggtcaacatatccgtagacacgtccaagaaccagttctccctgaagctgaactctgtgaccgccgcagacacggctgtgtattactgtgcgagacacagcagcagctggtctcttgactactggggccagggaaccctagtcaccgtctcctca

SEQ ID NO: 28806 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGIPYYNPSLKSRVNISVDTSKNQFSLKLNSVTAADTAVYYCARHSSSWSLDYWGQGTLVTVSS

SEQ ID NO: 28807 - DNA, 354 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataccatgaactgggtccgccaggctccagggaaggggctggagtgggtctcatccattagtggtagtggtagttacatatactacgcagactcagtgaagggccgattcaccatctccagagacaacgccaagaactcactgtatctgcaaatgaacagcctgagagccgaggacacggctgtgtattactgtgcgagagggagcagctcgtccgggtttgactactggggccagggaaccctggtcaccgtctcctca

SEQ ID NO: 28808 - protein, 118 aa, Artificial Sequence
  Description of Artificial Sequence: Synthetic polypeptide
EVQLVESGGGLVKPGGSLRLSCAASGFTFSSYTMNWVRQAPGKGLEWVSSISGSGSYIYYADSVKGRFTISRDNAKNSLYLQMNSLRAEDTAVYYCARGSSSSGFDYWGQGTLVTVSS

SEQ ID NO: 28809 - DNA, 363 bp, Artificial Sequence
  Description of Artificial Sequence: Synthetic polynucleotide
gaggtgcaggtgttggagtctgggggaggcttggtacagccgggggggtccctgagactctcctgtgcagcctctggactcacctttagcagctctgccatgagctgggtccgccaggctccagggaaggggctggagtgggtctcagctattagtggtcgtggtggtaacacattctacacagactccgtgaagggccggttcaccatttccagagacaattccaagaacacgctgtatctgcaaatgaacagcctgagagccgaggacacggccgtatattactgtgcgaaactggggaaagactactactactacggtatggacgtctggggccaagggaccacggtcaccgtctcctca

SEQ ID NO: 28810 - protein, 121 aa, Artificial Sequence
  Description of Artificial Sequence: Synthetic polypeptide
EVQVLESGGGLVQPGGSLRLSCAASGLTFSSSAMSWVRQAPGKGLEWVSAISGRGGNTFYTDSVKGRFTISRDNSKNTLYLQMNSLRAEDTAVYYCAKLGKDYYYYGMDVWGQGTTVTVSS

SEQ ID NO: 28811 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtttgatggaagtaataaatactatgcagactccgtgaagggccgattcaccatctccagagacaattccaagaacacgctgtatctgcaaatgaacagcctgagagccgaggacacggctgtgtatgactgtgcgagagatcttggctggacggaagagtactggggccagggaaccctggtcaccgtctcctca

SEQ ID NO: 28812 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFDGSNKYYADSVKGRFTISRDNSKNTLYLQMNSLRAEDTAVYDCARDLGWTEEYWGQGTLVTVSS

SEQ ID NO: 28813 - DNA, 357 bp, Artificial Sequence
  Description of Artificial Sequence: Synthetic polynucleotide
caactgcagctgcaggagtcgggcccaggactggtgaagccttcggagaccctgtccctcacctgcactgtctctggtggctccatcagcaggagtagttactactggggctggatccgccagcccccagggaaggggctggagtggattgggaatatctattatagtggggccacctactacaacccgtccctcaagagtcgagtcaccatctccgtagacacgtccacgaaccagttctccctgaagctgagctctgtgaccgccgcagacacggctgtgtattactgtgcgagacatagcggcagctggtcccttgactactggggccagggaaccctggtcaccgtctcctca

SEQ ID NO: 28814 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGATYYNPSLKSRVTISVDTSTNQFSLKLSSVTAADTAVYYCARHSGSWSLDYWGQGTLVTVSS

SEQ ID NO: 28815 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttcctactggggctggatccgccagcccccagggaaggggctggagtggattggaaatatctattatagtgggagcgcctactacattccgtccctcaagagtcgagtcaccatatccgtagccacgtccaagaaccagttctccctgaacctgacctctgtgaccgccgcagacacggctgtgtattactgtgcgcgacacagcagcagctggtctcttgactgctggggccagggaaccctggtcaccgtctcctca

SEQ ID NO: 28816 - protein, 119 aa, Artificial Sequence
  Description of Artificial Sequence: Synthetic polypeptide
QLQLQESGPGLVKPSETLSLTCTVSGGSISRSSSYWGWIRQPPGKGLEWIGNIYYSGSAYYIPSLKSRVTISVATSKNQFSLNLTSVTAADTAVYYCARHSSSWSLDCWGQGTLVTVSS

SEQ ID NO: 28817 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatttggtatgatagaagtaataactactatgcagactccgtgaagggccgattcaccatctccagagacaattccaagaatacgctgtatctgcaaatgaacagcctgagagccgaggacacggctgtgtattactgtgcgagagaactggggttccggtctgactactggggccagggaaccctggtcaccgtctcctca

SEQ ID NO: 28818 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDRSNNYYADSVKGRFTISRDNSKNTLYLQMNSLRAEDTAVYYCARELGFRSDYWGQGTLVTVSS

SEQ ID NO: 28819 - DNA, 351 bp, Artificial Sequence
  Description of Artificial Sequence: Synthetic polynucleotide
caggtgcagctggtggagtctgggggaggcgtggtccagcctgggaggtccctgagactctcctgtccagcgtctggattcaccttcagtgactttggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctgtgtattactgtgcgagagagctggggttccggtctgactactggggccagggaaccctggtcaccgtctcctca

SEQ ID NO: 28820 - protein, 117 aa, Artificial Sequence
  Description of Artificial Sequence: Synthetic polypeptide
QVQLVESGGGVVQPGRSLRLSCPASGFTFSDFGMHWVRQAPGKGLEWVAVIWYEENNQYYADSVKGRFTISRDNSKNTLYLQMNSLRAEDTAVYYCARELGFRSDYWGQGTLVTVSS

SEQ ID NO: 28821 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggaatgggtggcagttatatggtatgaggaaagtaataaatactatacagactccgtgaagggccgattcaccatctccagagacaattccaagaacacgctgtatctgcaaatgaacagcctgagacccgaggacacggctgtgtattactgtgcgagagaagtgggattcactgaggactactggggccagggaaccctggtcaccgtctcctca

SEQ ID NO: 28822 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEESNKYYTDSVKGRFTISRDNSKNTLYLQMNSLRPEDTAVYYCAREVGFTEDYWGQGTLVTVSS

SEQ ID NO: 28823 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgagctgggtccgccaggctccagggaaggggctggagtgggtctcaattattagtggtcgtggtggtaacacattctacgcagactccgtgaagggccggttcaccatctccagagacaattccaagaacactctgtatctgcaaatgaacagcctgagagccgaggacacggccgtatattactgtgcgtcccgtgtagcagtggctggctcggaggcttttgctatctggggccaagggacaatggtcaccgtctcttca

SEQ ID NO: 28824 - protein, 121 aa, Artificial Sequence
  Description of Artificial Sequence: Synthetic polypeptide
EVQLLESGGGLVQPGGSLRLSCAASEFTFSSYAMSWVRQAPGKGLEWVSIISGRGGNTFYADSVKGRFTISRDNSKNTLYLQMNSLRAEDTAVYYCASRVAVAGSEAFAIWGQGTMVTVSS

SEQ ID NO: 28825 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctgtttattactgtacgagagaactggggttccggtctgactactggggccagggaaccctggtcaccgtctcctca

SEQ ID NO: 28826 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEENNQYYADSVKGRFTISRDNSKNTLYLQMNSLRAEDTAVYYCTRELGFRSDYWGQGTLVTVSS

SEQ ID NO: 28827 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatttggtatgaagacaataatcaatactatgcagactccgtgaagggccgattcaccatctccagagacaattccaagaacacgctgtatctgcaaatgaacagcctgagagccgaggacacggctgtgtattactgtgcgagagaactggggttccggtctgactactggggccagggaaccctggtcaccgtctcctca

SEQ ID NO: 28828 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYEDNNQYYADSVKGRFTISRDNSKNTLYLQMNSLRAEDTAVYYCARELGFRSDYWGQGTLVTVSS

SEQ ID NO: 28829 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctgtgtattactgtgcgagagaactggggttccggtctgactactggggccagggaaccctggtcaccgtctcctca

SEQ ID NO: 28830 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYEENNQYYADSVKGRFTISRDNSKNTLYLQMNSLRAEDTAVYYCARELGFRSDYWGQGTLVTVSS

SEQ ID NO: 28831 - DNA, 357 bp, Artificial Sequence
  Description of Artificial Sequence: Synthetic polynucleotide
cagctgcagctgcaggagtcggggccaggactggtgaagccttcggagaccctgtccctcacctgcactgtctctggtggctccatcaacagaagtagttattactggggttggatccgccagcccccagggaaggggctggagtggattgggaatatctattatagtgggaccacctactacaacccgtccctcaagagtcgagtcaccatatccgtagacacgtccaagaaccagttctccctgaacctgagctctgtgaccgccgcagacacggctgtatattcctgtgcgagacatggaaaagactggggccttgactactggggccagggagccctggtcaccgtctcctca

SEQ ID NO: 28832 - protein, 119 aa, Artificial Sequence
  Description of Artificial Sequence: Synthetic polypeptide
QLQLQESGPGLVKPSETLSLTCTVSGGSINRSSYYWGWIRQPPGKGLEWIGNIYYSGTTYYNPSLKSRVTISVDTSKNQFSLNLSSVTAADTAVYSCARHGKDWGLDYWGQGALVTVSS

SEQ ID NO: 28833 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataccatgaactgggtccgccaggctccagggaaggggctggagtgggtctcatccattagtggtagtggtagttacatatactacgcagactcagtgaagggccgattcaccatctccagagacaacgccaagaactcactgtatctgcaaatgaacgccctgagagccgaggacacggctgtgtattactgtgcgagagtggcttcatttgactactggggccagggaaccctggtcaccgtctcctca

SEQ ID NO: 28834 - protein, 115 aa, Artificial Sequence
  Description of Artificial Sequence: Synthetic polypeptide
EVQLVESGGGLVKPGGSLRLSCAASGFTFSSYTMNWVRQAPGKGLEWVSSISGSGSYIYYADSVKGRFTISRDNAKNSLYLQMNALRAEDTAVYYCARVASFDYWGQGTLVTVSS

SEQ ID NO: 28835 - DNA, 351 bp, Artificial Sequence
  Description of Artificial Sequence: Synthetic polynucleotide
ctggtgcagctggtggagtctgggggaggcgtggtccagcctgggaagtccctgagactctcctgtgcagcgtctggattcaccttcagtgactatggcatacactgggtccgccaggctccaggcaaggggctggagtgggtggcagtcatttggtttgatggaagtaataaatactatgcagactccgtgaagggccgattcaccatctccagcgacaattccaaaaacacgctgtatctgcaaatgaacagcctgagagccgaggacacggctgtgtattactgtgcgagagatcttggctggacggaagagtactggggccagggaaccctggtcaccgtctcctca

SEQ ID NO: 28836 - protein, 117 aa, Artificial Sequence
  Description of Artificial Sequence: Synthetic polypeptide
LVQLVESGGGVVQPGKSLRLSCAASGFTFSDYGIHWVRQAPGKGLEWVAVIWFDGSNKYYADSVKGRFTISSDNSKNTLYLQMNSLRAEDTAVYYCARDLGWTEEYWGQGTLVTVSS

SEQ ID NO: 28837 - DNA, 354 bp, Artificial Sequence; identical to SEQ ID NO: 28403
  Description of Artificial Sequence: Synthetic polynucleotide

SEQ ID NO: 28838 - protein, 118 aa, Artificial Sequence; identical to SEQ ID NO: 28404
  Description of Artificial Sequence: Synthetic polypeptide

SEQ ID NO: 28839 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaacttcagtaactatggcatgcactgggtccgccaggctccaggcaaggggctggagtgggtggcagtcatatggcatgatggaagtaataaatactatgtagactccgtgaagggccgattcaccatctccagagacaattccaagaacacggtgtatctgcaaatgaacagcctgagagccgaggacacggctgtgtattactgtgcgagagatgagaggctggggatttttgactactggggccagggaaccctggtcaccgtctcctca

SEQ ID NO: 28840 - protein, 118 aa, Artificial Sequence
  Description of Artificial Sequence: Synthetic polypeptide
QVQLVESGGGVVQPGRSLRLSCAASGFNFSNYGMHWVRQAPGKGLEWVAVIWHDGSNKYYVDSVKGRFTISRDNSKNTVYLQMNSLRAEDTAVYYCARDERLGIFDYWGQGTLVTVSS

SEQ ID NO: 28841 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcggctatgccatgaactgggtccgccaggctccagggatggggctggagtgggtctcagttattagtcgtagtggtggttacacatactacgcggactccgtgaagggccggttcaccatctccagagacaattccaagaacacgctgtatctgcaaatgaacagcctgagagccgaggacacggccgtctattactgtgcgtcccgtttagcagtggctggctcggaggcttttgatatctggggccaagggacaatggtcaccgtctcttca

SEQ ID NO: 28842 - protein, 121 aa, Artificial Sequence
  Description of Artificial Sequence: Synthetic polypeptide
EVQLLESGGGLVQPGGSLRLSCAASGFTFSGYAMNWVRQAPGMGLEWVSVISRSGGYTYYADSVKGRFTISRDNSKNTLYLQMNSLRAEDTAVYYCASRLAVAGSEAFDIWGQGTMVTVSS

SEQ ID NO: 28843 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggcatgatgaaagtaataaatactatacagactccgtgaagggccgattcaccatctccagagacaattccaagaacacgctgtatctgcaaatgaacagcctgagagccgaggacacggctgtgtattactgtgcgagagacgagaggctggggatttttgactactggggccagggaaccctggtcaccgtctcctca

SEQ ID NO: 28844 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWHDESNKYYTDSVKGRFTISRDNSKNTLYLQMNSLRAEDTAVYYCARDERLGIFDYWGQGTLVTVSS

SEQ ID NO: 28845 - DNA, 351 bp, Artificial Sequence
  Description of Artificial Sequence: Synthetic polynucleotide
caggtgcagctggtggagtctgggggaggcgtggtccagcctgggaggtccctgagactctcctgttcagcgtctggattcaccttcagtgactatggcatgcactgggtccgccaggctccaggcaaggggctggagtgggtggcagttatatggtatgatgaaaataataaatactatgcagactccgtgaagggccgattcaccatctccagagacaattccaagaacacgctgtatctgcaaatgaacagcctgagagccgaggacacggctgtgtattactgtgcgagagaactggggttccggtctgactactggggccagggaaccctggtcaccgtctcctca

SEQ ID NO: 28846 - protein, 117 aa, Artificial Sequence
  Description of Artificial Sequence: Synthetic polypeptide
QVQLVESGGGVVQPGRSLRLSCSASGFTFSDYGMHWVRQAPGKGLEWVAVIWYDENNKYYADSVKGRFTISRDNSKNTLYLQMNSLRAEDTAVYYCARELGFRSDYWGQGTLVTVSS

SEQ ID NO: 28847 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgacgaaagtaataaatactatgaagactccgtgaagggccgattcaccatctccagagacaattccaagaacacgctgtatctgcaaatgaaaagcctgagagccgaggacacgggtgtgtattactgtgcgagagaagtgggattccggtctgactactggggccagggaaccctggtcaccgtctcctca

SEQ ID NO: 28848 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDESNKYYEDSVKGRFTISRDNSKNTLYLQMKSLRAEDTGVYYCAREVGFRSDYWGQGTLVTVSS

SEQ ID NO: 28849 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgagctgggtccgccaggctccagggaaggggctggagtgggtctcagttattagtggtcgtggtgttaacacattctacgcagactccgtgaagggccggttcaccatctccagagacaattccaagaacacgctgtatctgcaaatgaacagcctgagagccgaggacacggccgtatattactgtgcgtcccgtatagcagtggctggctcggaggcttttgatatctggggccaagggacaatggtcaccgtctcttca

SEQ ID NO: 28850 - protein, 121 aa, Artificial Sequence
  Description of Artificial Sequence: Synthetic polypeptide
EVQLLESGGGLVQPGGSLRLSCAASEFTFSSYAMSWVRQAPGKGLEWVSVISGRGVNTFYADSVKGRFTISRDNSKNTLYLQMNSLRAEDTAVYYCASRIAVAGSEAFDIWGQGTMVTVSS

SEQ ID NO: 28851 - DNA, 369 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatgtcctgcactgggtccgccaggctccaggcaaggggctggagtgggtggcagttatatggtatgatggaagtaataaatactatgcagactccgtgaagggccgattcaccatctccagagacaattccaagaacacgctatatctgcaaatgaacagcctgagagccgaggacacggctgtttattactgtgcgcgagaaaagtataccagcagctggtacgactacggtatggacgtctggggccaagggaccacggtcaccgtctcctca

SEQ ID NO: 28852 - protein, 123 aa, Artificial Sequence
  Description of Artificial Sequence: Synthetic polypeptide
QVQLVESGGGVVQPGRSLRLSCAASGFTFSSYVLHWVRQAPGKGLEWVAVIWYDGSNKYYADSVKGRFTISRDNSKNTLYLQMNSLRAEDTAVYYCAREKYTSSWYDYGMDVWGQGTTVTVSS

SEQ ID NO: 28853 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactttggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgagagccgaggacacggctttttattactgtgcgagagagctggggttccggtctgactactggggccagggaaccctggtcaccgtctcctca

SEQ ID NO: 28854 - protein, 117 aa, Artificial Sequence
  Description of Artificial Sequence: Synthetic polypeptide
QVQLVESGGGVVQPGRSLRLSCAASGFTFSDFGMHWVRQAPGKGLEWVAVIWYEENNQYYADSVKGRFTISRDNSKNTLYLQMNSLRAEDTAFYYCARELGFRSDYWGQGTLVTVSS

SEQ ID NO: 28855 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggcatgatgaaactaataaatactatgcagattccgtgaagggccgattcaccatctccagagacaattccaagaacacgctgtctctgcaaatgaacagcctgagagccgaggacacggctgtgtattactgtgcgagagacgagaggctggggatttttgactactggggccagggaaccctggtcaccgtctcctca

SEQ ID NO: 28856 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWHDETNKYYADSVKGRFTISRDNSKNTLSLQMNSLRAEDTAVYYCARDERLGIFDYWGQGTLVTVSS

SEQ ID NO: 28857 - DNA, 342 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgacatgagctgggtccgccaggctccaggaaaggggctggagtgggtctcaactattagtggtagtggtggtatcacatactacgcagactccgtgaagggccggttcaccatctccagagacaattccaagaaaacgctgtatctgcaaatgaacagcctgagagccgaggacacggccgtatatttctgtgcgagagatcggggcagcgtctggggccagggaaccctggtcaccgtctcctca

SEQ ID NO: 28858 - protein, 114 aa, Artificial Sequence
  Description of Artificial Sequence: Synthetic polypeptide
EVQLLESGGGLVQPGGSLRLSCAASGFTFSSYDMSWVRQAPGKGLEWVSTISGSGGITYYADSVKGRFTISRDNSKKTLYLQMNSLRAEDTAVYFCARDRGSVWGQGTLVTVSS

SEQ ID NO: 28859 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttactactggggctggatccggcagcccccagggaaggggctggagtggattgggaatatctattatagtgggagcacctactacaacccgtccgtcaagagtcgagtcaccatatccgtagacacgtccaagaaccagttctccctgaagctgagtactgtgaccgccgcagacacggctgtgtattactgtgcgagacatggaaaagactggggccttgaagactggggccagggaaccctggtcaccgtctcctca

SEQ ID NO: 28860 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYYNPSVKSRVTISVDTSKNQFSLKLSTVTAADTAVYYCARHGKDWGLEDWGQGTLVTVSS

SEQ ID NO: 28861 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctgcaaatgaacagcctgacagccgaggacacggctgtttattacagtccgagagaaatggggttcctgtctgactactggggccagggaaccctggtcaccgtctcctca

SEQ ID NO: 28862 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEENNQYYADSVKGRFTISRDNSKNTLYLQMNSLTAEDTAVYYSPREMGFLSDYWGQGTLVTVSS

SEQ ID NO: 28863 - DNA, 351 bp, Artificial Sequence
  Description of Artificial Sequence: Synthetic polynucleotide
caggtgcaggtggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtttgatggaagtaataaatactatgcagactccgtgaagggccgattcaccatctccagagacaattccaagaacacgctgtatctgcaaatgaacagtctgagagccgaggacacggctgtgtattactgtgcgagagatcttggctggacggaagagtactggggccagggaaccccggtcaccgtctcctca

SEQ ID NO: 28864 - protein, 117 aa, Artificial Sequence
  Description of Artificial Sequence: Synthetic polypeptide
QVQVVESGGGVVQPGRSLRLSCAASGFTFSDYGMHWVRQAPGKGLEWVAVIWFDGSNKYYADSVKGRFTISRDNSKNTLYLQMNSLRAEDTAVYYCARDLGWTEEYWGQGTPVTVSS

SEQ ID NO: 28865 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagttattagtggtagtggtggtagcacatactacgcagactccgtgaagggccggttcaccatctccagagacaattccaagaacacgctgtatttgcaaatgaacaccctgagagccgaggacacggccgtatattactgtgcgaaaaggtataccagtgactggcatgatgcttttgatatctggggccaagggacaatggtcaccgtctcttca

SEQ ID NO: 28866 - protein, 121 aa, Artificial Sequence
  Description of Artificial Sequence: Synthetic polypeptide
EVQLLESGGGLVQPGGSLRLSCAASGFTFSSYAMNWVRQAPGKGLEWVSVISGSGGSTYYADSVKGRFTISRDNSKNTLYLQMNTLRAEDTAVYYCAKRYTSDWHDAFDIWGQGTMVTVSS

SEQ ID NO: 28867 - DNA, 357 bp, Artificial Sequence
  Description of Artificial Sequence: Synthetic polynucleotide
cagctgcatctgcaggagtcgggcccaggactggtgaagccttcggagaccctgtccctcacctgcactgtctctggtggctccatcagcagaagtagttactactggggctggatccgccagcccccagggaaggggctggagtggattgggagtatctattatagtgggagcgcccagtacaacccgtccctcaagagtcgagtcaccatatccgtagacacgaccaagaaccagttctccctgacgctgagctctgtgaccgccgcagacacggctgtatattactgtgcgagactgagcagcagctggtcttttgactactggggccagggaaccctggtcaccgtctcctca

SEQ ID NO: 28868 - protein, 119 aa, Artificial Sequence
  Description of Artificial Sequence: Synthetic polypeptide
QLHLQESGPGLVKPSETLSLTCTVSGGSISRSSYYWGWIRQPPGKGLEWIGSIYYSGSAQYNPSLKSRVTISVDTTKNQFSLTLSSVTAADTAVYYCARLSSSWSFDYWGQGTLVTVSS

SEQ ID NO: 28869 - DNA, 351 bp, Artificial Sequence
  Description of Artificial Sequence: Synthetic polynucleotide
caggtgcagttggtggagtctgggggaaccgtggtccagcctgggaggtccctgagactctcctgtgcagcgtctggattcaccttcagtagctatggcatgcactgggtccgccaggctccaggcaaggggctggagtgggtggcagttatatggtatgaggaaaataataaacactatgcagactccgtgaagggccgattcaccatctccagagacaattccaagaacacgctgtatctgcaaatgaacagcctgagagccgaggacacggctgtgtattactgtgcgagagagctggggttcctctctgactactggggccagggaaccctggtcaccgtctcctca

SEQ ID NO: 28870 - protein, 117 aa, Artificial Sequence
  Description of Artificial Sequence: Synthetic polypeptide
QVQLVESGGTVVQPGRSLRLSCAASGFTFSSYGMHWVRQAPGKGLEWVAVIWYEENNKHYADSVKGRFTISRDNSKNTLYLQMNSLRAEDTAVYYCARELGFLSDYWGQGTLVTVSS

SEQ ID NO: 28871 - DNA, 351 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgaaggaagtaatcaatactatggagactccgtgaagggccgattcaccatctccagagacaattccaagaacacggtgtatctgcaaatgcacagcctgagagccgaggacacggctgtgtattactgtgcgagagagctggggttcctctctgactactggggccagggaaccctggtcaccgtctcctca

SEQ ID NO: 28872 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEGSNQYYGDSVKGRFTISRDNSKNTVYLQMHSLRAEDTAVYYCARELGFLSDYWGQGTLVTVSS

SEQ ID NO: 28873 - DNA, 354 bp, Artificial Sequence
  Description of Artificial Sequence: Synthetic polynucleotide
caactgcagctgcaggagtcgggcccaggactggtgaagccttcggagaccctgtccctcacctgcactgtctctggtggctccatcagacctaattactactggggctggatccgccagcccccagggaaggggctggagtggattggtagtatctattatagtggaagcacctcctacaacccgtccctcaacagtcgagtcaccatatccgtggacacgtccaagaaccagttctccctgaagctgaactctgtgaccgccgcagacacggctgtgtattactgtgcgagactaagcagcaactgggactttgacaactggggccagggaaccctggtcaccgtctcctca

SEQ ID NO: 28874 - protein, 118 aa, Artificial Sequence
  Description of Artificial Sequence: Synthetic polypeptide
QLQLQESGPGLVKPSETLSLTCTVSGGSIRPNYYWGWIRQPPGKGLEWIGSIYYSGSTSYNPSLNSRVTISVDTSKNQFSLKLNSVTAADTAVYYCARLSSNWDFDNWGQGTLVTVSS

SEQ ID NO: 28875 - DNA, 363 bp, Artificial Sequence
  Description of Artificial Sequence: Synthetic polynucleotide
gaggtgcagctgttggagtctgggggaaccttggtacagcctggggggtccctgagactctcctgtgcagcctctgaattcacctttagcagctatgtcatgagctgggtccgccaggctccagggaaggggctggagtgggtctcaattattagtggtcgtggtggtaacacattctacgcagactccgtgaagggccggttcaccatctccagagacaattccaagaacacgctgtatctgcaaatgaacagcctgagagccgaggacacggccttatattactgtgcgtcccgtttagcagtggctggctcggaggcttttgatatctggggccaagggacaatggtcaccgtctcttca

SEQ ID NO: 28876 - protein, 121 aa, Artificial Sequence
  Description of Artificial Sequence: Synthetic polypeptide
EVQLLESGGTLVQPGGSLRLSCAASEFTFSSYVMSWVRQAPGKGLEWVSIISGRGGNTFYADSVKGRFTISRDNSKNTLYLQMNSLRAEDTALYYCASRLAVAGSEAFDIWGQGTMVTVSS

SEQ ID NO: 28877 - DNA, 360 bp, Artificial Sequence
  Description of Artificial Sequence: Synthetic polynucleotide
caggtgcagctgcaggagtcgggcccaggactggtgaagccttcggagaccctgtccctcacctgtagtgtctctggtgactccatcagtagttactcctggagctggatccggcagcccgccgggaagggactggaatggattgggcgtatctataccagtgggagcaccaactacatcccctccctcaagagtcgaatcaccatgtcagtagacacgtccaagaagcagttctccctgaagctgagctctgtgaccgccgcggacacggccgtgtattactgtgcgagagatttgaagagcagtggctgccttttctttgactactggggccagggaaccctggtcaccgtctcctca

SEQ ID NO: 28878 - protein, 120 aa, Artificial Sequence
  Description of Artificial Sequence: Synthetic polypeptide
QVQLQESGPGLVKPSETLSLTCSVSGDSISSYSWSWIRQPAGKGLEWIGRIYTSGSTNYIPSLKSRITMSVDTSKKQFSLKLSSVTAADTAVYYCARDLKSSGCLFFDYWGQGTLVTVSS

SEQ ID NO: 28879 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggatttaccttcagtagctatggcatgcactgggtccgccagactccaggcaaggggctggagtgggtggcaattatatcatatgttggaaagaataaatattatgcagactccgtgaagggccgattcaccatctccagagacaattccaagaacacgctgtatctgcaaatgaacagcctgagagctgaggacacggctgtgtattactgtgcgagacggggaaacagctatggcgggtacggtatggacgtctggggccaagggactacggtcaccgtctcctca

SEQ ID NO: 28880 - protein, 121 aa, Artificial Sequence
  Description of Artificial Sequence: Synthetic polypeptide
QVQLVESGGGVVQPGRSLRLSCAASGFTFSSYGMHWVRQTPGKGLEWVAIISYVGKNKYYADSVKGRFTISRDNSKNTLYLQMNSLRAEDTAVYYCARRGNSYGGYGMDVWGQGTTVTVSS

SEQ ID NO: 28881 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgattcaccatctccagagacaacgccaagaactcactgtatctgcaaatgaacagcctgagagccgaggacacggctgtgttttactgtgcgagagtggcttcatttgactactggggccagggaaccctggtcaccgtctcctca

SEQ ID NO: 28882 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYIYYADSVKGRFTISRDNAKNSLYLQMNSLRAEDTAVFYCARVASFDYWGQGTLVTVSS

SEQ ID NO: 28883 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgaatcgccatctccagagacaacgccaagaactcgctgtatctgcaaatgaacagcctgagagccgaggacacggctgtatattactgtgcgagagtggcttcatttgactactggggccagggaaccctggtcaccgtctcctca

SEQ ID NO: 28884 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYIYYADSVKGRIAISRDNAKNSLYLQMNSLRAEDTAVYYCARVASFDYWGQGTLVTVSS

SEQ ID NO: 28885 - DNA, 363 bp, Artificial Sequence
  Description of Artificial Sequence: Synthetic polynucleotide
gaggtgcagttgttggagtctgggggaggcttggtacagcctggggggtccctgagactctcctgtgcagcctctgaattcacctttagcagctatgccatgagctgggtccgccaggctccagggaaggggctggagtgggtctcaattattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtatagcagtggctggctcggaggcttttgctatctggggccaagggacaatggtcaccgtctcttca

SEQ ID NO: 28886 - protein, 121 aa, Artificial Sequence
  Description of Artificial Sequence: Synthetic polypeptide
EVQLLESGGGLVQPGGSLRLSCAASEFTFSSYAMSWVRQAPGKGLEWVSIISGRGGNTFYADSVKGRFTISRDNSKNTLYLQMNSLRAEDTAVYYCASRIAVAGSEAFAIWGQGTMVTVSS

SEQ ID NO: 28887 - DNA, 354 bp, Artificial Sequence
  Description of Artificial Sequence: Synthetic polynucleotide
caggtgcagctggtggagtcggggggaggcgtggtccagcctgggaggtccctgagactctcctgtgcagcgtctggattcaacttcagtaactatggcatgcactgggtccgccaggttccaggcaaggggctggagtgggtggcagttatatggcatgatggaagtaataaatactatgtagactccgtgaagggccgattcaccatctccagagacaattccaagaacacgctgtctctgcaaatgaacagcctgagagccgaggacacggctgtgtattgctgtgcgagagatgagaggctggggatttttgactactggggccagggaaccctggtcaccgtctcctca

SEQ ID NO: 28888 - protein, 118 aa, Artificial Sequence
  Description of Artificial Sequence: Synthetic polypeptide
QVQLVESGGGVVQPGRSLRLSCAASGFNFSNYGMHWVRQVPGKGLEWVAVIWHDGSNKYYVDSVKGRFTISRDNSKNTLSLQMNSLRAEDTAVYCCARDERLGIFDYWGQGTLVTVSS

SEQ ID NO: 28889 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatggaagtaataaatactatgcagactccgtgaagggccgattcaccatctccagagacaattccaagaacacgctctatctgcaaatgaacagcctgagagccgaggacacggctgtgtattactgtgcgagagagaagtatagcagcagctggtacgactacggtatggacgtctggggccaagggaccacggtcaccgtctcctca

SEQ ID NO: 28890 - protein, 123 aa, Artificial Sequence
  Description of Artificial Sequence: Synthetic polypeptide
QVQLVESGGGVVQPGRSLRLSCAASGFTFSDYGMHWVRQAPGKGLEWVAVIWYDGSNKYYADSVKGRFTISRDNSKNTLYLQMNSLRAEDTAVYYCAREKYSSSWYDYGMDVWGQGTTVTVSS

SEQ ID NO: 28891 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctataacatgcactgggtccgccaggctccaggcaaggggctggagtgggtggcagttatatggtatgatggaagtgatagatactctgcagactccgtgaagggccgattcaccatctcccgagacaattccaagaacacgctgtatctgcaaatgaacagcctgagagccgaggacacggctgtgtattactgtgcgagagatcgggcctatagcagctcgtctgacttctggggccagggaaccctggtcaccgtctcctca

SEQ ID NO: 28892 - protein, 119 aa, Artificial Sequence
  Description of Artificial Sequence: Synthetic polypeptide
QVQLVESGGGVVQPGRSLRLSCAASGFTFSTYNMHWVRQAPGKGLEWVAVIWYDGSDRYSADSVKGRFTISRDNSKNTLYLQMNSLRAEDTAVYYCARDRAYSSSSDFWGQGTLVTVSS

SEQ ID NO: 28893 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttataccatgaactgggtccgccaggctccagggaaggggctggactgggtctcatccattagtggtagtagtagttacatatactacgcggactcagtgaagggccgattcaccatctccagagacaacgccaagaactcactgtatctgcaaatgaacagcctgagagccgaggacacggctgtgtattactgtgcgagagatcggggcagtggctggggccagggaaccctggtcaccgtctcctca

SEQ ID NO: 28894 - protein, 114 aa, Artificial Sequence
  Description of Artificial Sequence: Synthetic polypeptide
EVQLVESGGGLVKPGGSLRLSCAASGFTFSSYTMNWVRQAPGKGLDWVSSISGSSSYIYYADSVKGRFTISRDNAKNSLYLQMNSLRAEDTAVYYCARDRGSGWGQGTLVTVSS

SEQ ID NO: 28895 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatacactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaaagtatagcagcagctggtacgactacggtatggacgtctggggccaagggaccacggtcaccgtctcctca

SEQ ID NO: 28896 - protein, 123 aa, Artificial Sequence
  Description of Artificial Sequence: Synthetic polypeptide
QVQLVESGGGVVQPGRSLRLSCAASGFTFSNYVIHWVRQAPGKGLEWVAVIWYDGSNKYYADSVKGRFTISRDNSKNTLYLQMNSLRAEDTAVYYCAREKYSSSWYDYGMDVWGQGTTVTVSS

SEQ ID NO: 28897 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgtcagttatatcatatggtggaagtaataattactatgcagactccgtgaagggccgattcaccatctccagagacaattccaagaacacgctgtatctgcaaatgaacagcctgagagctgaggacacggctgtgtattactgtgtgagacggggatacagctatggcgggtacggtatggacgtctggggccaagggaccacggtcaccgtctcctca

SEQ ID NO: 28898 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVSVISYGGSNNYYADSVKGRFTISRDNSKNTLYLQMNSLRAEDTAVYYCVRRGYSYGGYGMDVWGQGTTVTVSS

SEQ ID NO: 28899 - DNA, 351 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcaccgggtccgccaggctccaggcaaggggctggagtgggtggcagttatatggtatgaaggaagtaatcaatactatggagactccgtgaagggccgattcaccatctccagagacaattccaagaacacggtgtatctgcaaatgcacagcctgagagccgaggacacggctgtgtattactgtgcgagagagctggggttcctctctgattactggggccagggaaccctggtcaccgtctcctca

SEQ ID NO: 28900 - protein, 117 aa, Artificial Sequence
  Description of Artificial Sequence: Synthetic polypeptide
QVQLVESGGGVVQPGRSLRLSCAASGFTFSNYGMHRVRQAPGKGLEWVAVIWYEGSNQYYGDSVKGRFTISRDNSKNTVYLQMHSLRAEDTAVYYCARELGFLSDYWGQGTLVTVSS

SEQ ID NO: 28901 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtggatctcatccattagtggtagtagtacttacatatactacgcagactcagtgaagggccgattcaccatctccagagacaacgccaagaactcactgtatctgcaaatgaacagcctgagagccgaggacacggctgtgtattactgtgcgagagtggcttcattcgactactggggccagggaaccctggtcaccgtctcctca

SEQ ID NO: 28902 - protein, 115 aa, Artificial Sequence
  Description of Artificial Sequence: Synthetic polypeptide
EVQLVESGGGLVKPGGSLRLSCAASGFTFSSYSMNWVRQAPGKGLEWISSISGSSTYIYYADSVKGRFTISRDNAKNSLYLQMNSLRAEDTAVYYCARVASFDYWGQGTLVTVSS

SEQ ID NO: 28903 - DNA, 369 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaagtatagcagcagctggtacgactacggtatggacgtctggggccacgggaccacggtcaccgtctcctca

SEQ ID NO: 28904 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCAREKYSSSWYDYGMDVWGHGTTVTVSS

SEQ ID NO: 28905 - DNA, 354 bp, Artificial Sequence
  Description of Artificial Sequence: Synthetic polynucleotide
caggtgcagctggtggagtctgggggaggcgtggtccagtctgggaggtccctgagactctcctgtgcagcgtctggattcaacttcagtagctatggcatgcactgggtccgccaggctccaggcaaggggctggagtgggtggcaattatatggcatgatggaagtaataaatactatgtagactccgtgaagggccgattcaccatctccagagacaattccaagaacacgctgtatctgcaaatgaacagcctgagagccgaggacacggctgtgtattactgtgcgagagatgagaggctggggatttttgactactggggccagggaaccctggtcaccgtctcctca

SEQ ID NO: 28906 - protein, 118 aa, Artificial Sequence
  Description of Artificial Sequence: Synthetic polypeptide
QVQLVESGGGVVQSGRSLRLSCAASGFNFSSYGMHWVRQAPGKGLEWVAIIWHDGSNKYYVDSVKGRFTISRDNSKNTLYLQMNSLRAEDTAVYYCARDERLGIFDYWGQGTLVTVSS

SEQ ID NO: 28907 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaggaaaataataaatactatgtagactccgtgaagggccgattcaccatctccagagacaattccaagagcacgctgtatctgcaaatgaacagcctgagagccgaggacacggctgtgtattactgtgtgagagaactaggcttccagtctgactactggggccagggaaccccggtcaccgtctcctca

SEQ ID NO: 28908 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYEENNKYYVDSVKGRFTISRDNSKSTLYLQMNSLRAEDTAVYYCVRELGFQSDYWGQGTPVTVSS

SEQ ID NO: 28909 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtccggattcaccttcagtagctatggcatgcactgggtccgccaggctccaggcaaggggctggagtggggggcagttatatggcatgatggaagtaataaatactatgcagactccgtgaagggccgattcaccatctccagagacaatgccaagaacacgctgtatctgcaaatgaacagcctgagagccgaggacacggctgtgtattactgtgcgagagatctgagaatgggcggtatggacgtctggggccaagggaccacggtcaccgtctcctca

SEQ ID NO: 28910 - protein, 118 aa, Artificial Sequence
  Description of Artificial Sequence: Synthetic polypeptide
QVQLVESGGGVVQPGRSLRLSCAASGFTFSSYGMHWVRQAPGKGLEWGAVIWHDGSNKYYADSVKGRFTISRDNAKNTLYLQMNSLRAEDTAVYYCARDLRMGGMDVWGQGTTVTVSS

SEQ ID NO: 28911 - DNA, 357 bp, Artificial Sequence
  Description of Artificial Sequence: Synthetic polynucleotide
cagctgcagctacaggagtcgggcccaggactggtgaagccttcggagaccctgtccctcacctgcactgtctctggtggctccatcagccgtagtagttactactggggctggatccgccagcccccagggaaggggctggagtggattgggagtgtctattatagtggggccacctcctacaacccgtccctcaagagtcgagtcaccatatccgtagacacgtccaagaaccagttttccctgaagctgaactctgtgaccgccgcagacacggctttgtattactgtgtgagactaagcagcaactgggactttgactactggggccagggaaccctgttcaccgtctcctca

SEQ ID NO: 28912 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGSVYYSGATSYNPSLKSRVTISVDTSKNQFSLKLNSVTAADTALYYCVRLSSNWDFDYWGQGTLFTVSS

SEQ ID NO: 28913 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatatggcatgatggaagtaataaatactatgcagactccgtgaagggccgattcaccatctccagagacaattccaacaacacgctgtatctgcaaatgagcagcctgcgagccgaggacacggctgtgtattactgtgcgagagatctgagtatgggcggtatggacgtctggggccaagggaccacggtcaccgtctcctca

SEQ ID NO: 28914 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHDGSNKYYADSVKGRFTISRDNSNNTLYLQMSSLRAEDTAVYYCARDLSMGGMDVWGQGTTVTVSS

SEQ ID NO: 28915 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaacttcagtagctatggcatgcactgggtccgccaggctccaggcaaggggctggagtgggtgtcaattatatggcatgatggaagtaataaatattatgtagactccgtgaagggccgattcaccatctccagagacaattccaagaacacgctgtatctgcaaatgaacagcctgagagccgaggacacggctgtgtattactgtgcgagagatgagaggctggggatttttgactactggggccagggaaccctggtcaccgtctcctcg

SEQ ID NO: 28916 - protein, 118 aa, Artificial Sequence
  Description of Artificial Sequence: Synthetic polypeptide
QVQLVESGGGVVQPGRSLRLSCAASGFNFSSYGMHWVRQAPGKGLEWVSIIWHDGSNKYYVDSVKGRFTISRDNSKNTLYLQMNSLRAEDTAVYYCARDERLGIFDYWGQGTLVTVSS

SEQ ID NO: 28917 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaaataataaatattatatagactccgtgaagggccgattcaccatctccagagacaactccaagaacacgctgtatctgcaaatgaacagcctgagagccgaggacacggctgtgtattactgtgcgagagaattggggttccggtctgactactggggccagggaaccctggtcaccgtctcctca

SEQ ID NO: 28918 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDENNKYYIDSVKGRFTISRDNSKNTLYLQMNSLRAEDTAVYYCARELGFRSDYWGQGTLVTVSS

SEQ ID NO: 28919 - DNA, 360 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagttattagtggtagaggtggtagtacatactacgcagactccgtgaagggccggttcaccatctccagagacaattccaagaacacgctgtatctgcaaatgaacagcctgagagccgaggacacggccgtatattactgtgcgaaaaggatagcagctggtatggagtacttcgatctctggggccgtggcaccctggtcactgtctcctca

SEQ ID NO: 28920 - protein, 120 aa, Artificial Sequence
  Description of Artificial Sequence: Synthetic polypeptide
EVQLLESGGGLVQPGGSLRLSCAASGFTFSSYAMNWVRQAPGKGLEWVSVISGRGGSTYYADSVKGRFTISRDNSKNTLYLQMNSLRAEDTAVYYCAKRIAAGMEYFDLWGRGTLVTVSS

SEQ ID NO: 28921 - DNA, 369 bp, Artificial Sequence
  Description of Artificial Sequence: Synthetic polynucleotide
gaggtgcagttgttggagtctgggggaggcttggtacagccgggggggtccctgagactctcctgtgcagcctctggattcacctttagcagctatgccatgacctgggtccgccaggctccagggaaggggccggagtgggtctcagttattagtggtagtggtggtagcacattctacgcagactccgtgaagggccggttcaccatctccagagacaattccaagaacacgctttatctgcaaatgagcagcctgagagccgaggacacggccgtttatttctgtgcccgatattgtagtagtaccaggtgcccttatgatgcctttgatatctggggccaagggacaatggtcaccgtctcctca

SEQ ID NO: 28922 - protein, 123 aa, Artificial Sequence
  Description of Artificial Sequence: Synthetic polypeptide
EVQLLESGGGLVQPGGSLRLSCAASGFTFSSYAMTWVRQAPGKGPEWVSVISGSGGSTFYADSVKGRFTISRDNSKNTLYLQMSSLRAEDTAVYFCARYCSSTRCPYDAFDIWGQGTMVTVSS

SEQ ID NO: 28923 - DNA, 354 bp, Artificial Sequence
  Description of Artificial Sequence: Synthetic polynucleotide
caggtgcaactggtgcagtctgggcctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtgccaccggctatgcacagaggttccagggcagagtcaccatgaccaggaacacctccataagcacagcctacatggagctgagcagcctgagatctgaggacacggccgtgtattactgtgcgacaagcagtggctgggaggtctttgactactggggccagggaaccctggtcaccgtctcctca

SEQ ID NO: 28924 - protein, 118 aa, Artificial Sequence
  Description of Artificial Sequence: Synthetic polypeptide
QVQLVQSGPEVKKPGASVKVSCKASGYTFTNYDINWVRQATGQGLEWMGWMHPNSGATGYAQRFQGRVTMTRNTSISTAYMELSSLRSEDTAVYYCATSSGWEVFDYWGQGTLVTVSS

SEQ ID NO: 28925 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttataccatgaactgggtccgccaggctccagggaaggggctggagtgggtctcatccattagtggtagtggtagttacatatactacgcagactcagtgaagggccgattcaccatgtccagagacaacgccaagaactcactgtatctgcaaatgaacagcctgagagccgaggacacggctgtgtattactgtgcgagagtagcagcctttgactcctggggccagggaaccctggtctccgtctcctca

SEQ ID NO: 28926 - protein, 115 aa, Artificial Sequence
  Description of Artificial Sequence: Synthetic polypeptide
EVQLVESGGGLVKPGGSLRLSCAASGFTFSSYTMNWVRQAPGKGLEWVSSISGSGSYIYYADSVKGRFTMSRDNAKNSLYLQMNSLRAEDTAVYYCARVAAFDSWGQGTLVSVSS

SEQ ID NO: 28927 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagcagctatagcatgaactgggtccgccaggctccagggaaggggctggagtgggtctcatccattagtggtagtagtacttacaaatactacgcagactcagtgaagggccgattcaccatctccagagacaacgccaagaactcactgtatctgcaaatgaacagcctgagaaccgaggacacggctgtgtattactgtgcgagagatcgtgggagctactggggccagggaacccaggtcaccgtctcctca

SEQ ID NO: 28928 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYKYYADSVKGRFTISRDNAKNSLYLQMNSLRTEDTAVYYCARDRGSYWGQGTQVTVSS

SEQ ID NO: 28929 - DNA, 351 bp, Artificial Sequence
  Description of Artificial Sequence: Synthetic polynucleotide
caggtgcagctggtggagtctgggggaggcgtggtccagcctgggaggtccctaagactctcctgtgcagcgtctggattcaccttcagtgactatggcatgcactgggtccgccaggctccaggcaaggggctggagtgggtggcagttatatggtttgatggaagtaataaatactatgtagactccgtgaagggccgattcaccatctccagagacaattccaagaacacgctgtatctgcaaatgagcagcctgagagccgaggacacggctgtgtattactgtgcgagagatcttggctggacggaagagtactggggccagggaaccctggtcaccgtctcctca

SEQ ID NO: 28930 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFDGSNKYYVDSVKGRFTISRDNSKNTLYLQMSSLRAEDTAVYYCARDLGWTEEYWGQGTLVTVSS

SEQ ID NO: 28931 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagagatatagcagtggctggtatgactacggtttggacgtctggggccaagggaccacggtcaccgtctcctca

SEQ ID NO: 28932 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCARERYSSGWYDYGLDVWGQGTTVTVSS

SEQ ID NO: 28933 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataacatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagttaacctctttgactactggggccagggaaccctggtcaccgtctcctca

SEQ ID NO: 28934 - protein, 115 aa, Artificial Sequence
  Description of Artificial Sequence: Synthetic polypeptide
EVQLVESGGGLVKPGGSLRLSCAASGFTFSSYNMNWVRQAPGKGLEWVSSISSSSSYIYYADSVKGRFTISRDNAKNSLYLQMNSLRAEDTAVYYCARVNLFDYWGQGTLVTVSS

SEQ ID NO: 28935 - DNA, 351 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaccgactactatttgcactgggtgcgacaggcccctggacaaggtcttgagtggatgggatggatccaccctaacagtggtggcacaaactatgcacagaagtttcagggcagggtcaccatgaccagggacacgtccatcagcacagcctacatggggctgagcagtctgagatctgacgacacggccgtgtattactgtgcgagagatggtaccagctcgtttgactactggggccagggaaccctggtcaccgtctcctca

SEQ ID NO: 28936 - protein, 117 aa, Artificial Sequence
  Description of Artificial Sequence: Synthetic polypeptide
QVQLVQSGAEVKKPGASVKVSCKASGYTFTDYYLHWVRQAPGQGLEWMGWIHPNSGGTNYAQKFQGRVTMTRDTSISTAYMGLSSLRSDDTAVYYCARDGTSSFDYWGQGTLVTVSS

SEQ ID NO: 28937 - DNA, 369 bp, Artificial Sequence
  Description of Artificial Sequence: Synthetic polynucleotide
gaggtgaagctgttggagtctgggggaggcttggtacagccgggggggtccctgagactctcctgtgcagcctctggattcaccttcagcagctatgccatgagctgggtccgccaggctccagggaaggggctggagtgggtctcagttcttagtggtagtggtggtagcacattctacgcagactccgtgaagggccggttcaccatctccagagacaattccaagaacacgctgtatctgcaaatgagcagcctgagagccggggacacggccgtatatttctgtgcccgatattgtagtagtgccaggtgcccttatgatgcctttgatatctggggccaagggacaatggtcaccgtctcctca

SEQ ID NO: 28938 - protein, 123 aa, Artificial Sequence
  Description of Artificial Sequence: Synthetic polypeptide
EVKLLESGGGLVQPGGSLRLSCAASGFTFSSYAMSWVRQAPGKGLEWVSVLSGSGGSTFYADSVKGRFTISRDNSKNTLYLQMSSLRAGDTAVYFCARYCSSARCPYDAFDIWGQGTMVTVSS

SEQ ID NO: 28939 - DNA, 354 bp, Artificial Sequence
  Description of Artificial Sequence: Synthetic polynucleotide
gaggtgcagctggtggagtctgggggaggcctggtcaagcctggggggtccttgagactctcctgtgcagcctctggattcacattcagtagctataccatgaactgggtccgccaggctccagggaaggggctggagtgggtctcatccattagtggtagtagtagttacatatactacgcagactcagtgaagggccgattcaccatctccagagccaacgccaagaactcattgtatctgcaaatgaacagcctgagagccgaggacacggctgtgtattactgtgcgagagggagcagctcgtccggctttgactactggggccagggaaccctggtcaccgtctcctca

SEQ ID NO: 28940 - protein, 118 aa, Artificial Sequence
  Description of Artificial Sequence: Synthetic polypeptide
EVQLVESGGGLVKPGGSLRLSCAASGFTFSSYTMNWVRQAPGKGLEWVSSISGSSSYIYYADSVKGRFTISRANAKNSLYLQMNSLRAEDTAVYYCARGSSSSGFDYWGQGTLVTVSS

SEQ ID NO: 28941 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtcaggattcaccttcagtgactatggcatgcactgggtccgccaggctccaggcaaggggctggagtggatggcagttatatggtatgatgtaactaataaatactatgcagactccgtgaagggccgattcaccatctccagagacaattccaagaacacgctgtatctgcaactgaacagcctgagagccgaggacacggctgtttattactgtgcgagagaacttggctggtacgaggactactggggccagggaaccctggtcaccgtctcctca

SEQ ID NO: 28942 - protein, 117 aa, Artificial Sequence
  Description of Artificial Sequence: Synthetic polypeptide
QVQLVESGGGVVQPGRSLRLSCAASGFTFSDYGMHWVRQAPGKGLEWMAVIWYDVTNKYYADSVKGRFTISRDNSKNTLYLQLNSLRAEDTAVYYCARELGWYEDYWGQGTLVTVSS

SEQ ID NO: 28943 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaaggggctggagtggattgggaatatctattatagtgggagcacctactacatcccgtccctcaagagtcgagtcaccatatccgttgacacgtccaagaaccagttctccctgaaactgagctctgtgaccgccgcagacacggctgtgtattactgtgcgagacacagtaccagctggtctcttgaccactggggccagggaaccctggtcaccgtctcctca

SEQ ID NO: 28944 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYYIPSLKSRVTISVDTSKNQFSLKLSSVTAADTAVYYCARHSTSWSLDHWGQGTLVTVSS

SEQ ID NO: 28945 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcatcttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctatgtattactgtgcgagagatctgagtatgggcggtatggacgtctggggccaagggaccacggtcaccgtctcctca

SEQ ID NO: 28946 - protein, 118 aa, Artificial Sequence
  Description of Artificial Sequence: Synthetic polypeptide
QVQLVESGGGVVQPGRSLRLSCAASGFIFSSYGMHWVRQAPGKGLEWVAIIWYDGSNKYYADSVKGRFTISRDNSKNTLYLQMNSLRAEDTAMYYCARDLSMGGMDVWGQGTTVTVSS

SEQ ID NO: 28947 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctgtgtcatgcactgggtccgccaggctccaggcaaggggctggagtgggtggcagttatatggtatgatggaagtaataaatactatgcagactccgtgaagggccgattcaccatctccagagacaattccaataacacgctgtatctgcaaatgaacagcctgagagccgaggacacggctgtgtattactgtgcgagagaaaggtataccagtggctggcacgactacggtatggacgtctggggccaagggaccacggtcaccgtctcctcg

SEQ ID NO: 28948 - protein, 123 aa, Artificial Sequence
  Description of Artificial Sequence: Synthetic polypeptide
QVQLVESGGGVVQPGRSLRLSCAASGFTFSSCVMHWVRQAPGKGLEWVAVIWYDGSNKYYADSVKGRFTISRDNSNNTLYLQMNSLRAEDTAVYYCARERYTSGWHDYGMDVWGQGTTVTVSS

SEQ ID NO: 28949 - DNA, 345 bp, Artificial Sequence
  Description of Artificial Sequence: Synthetic polynucleotide
gaggtgcagctgtgggagtctgggggaggcttggtacagcctggggggtccctgagactctcctgtgcagcctccggattcacctttagcagctatgccatgaactgggtccgccaggctccagggaaggggctggagtgggtctcagctattagtggtagtggtggttacacatactacgcagactccgtgaagggccggttcaccatctcccgagacaattccaagaacacgctgtatctgcaaatgagcagcctgagagccgaggacacggccgtttattactgtgcgaaaggggggtccctcttctactggggccagggaaccttggtcaccgtctcttca

SEQ ID NO: 28950 - protein, 115 aa, Artificial Sequence
  Description of Artificial Sequence: Synthetic polypeptide
EVQLWESGGGLVQPGGSLRLSCAASGFTFSSYAMNWVRQAPGKGLEWVSAISGSGGYTYYADSVKGRFTISRDNSKNTLYLQMSSLRAEDTAVYYCAKGGSLFYWGQGTLVTVSS

SEQ ID NO: 28951 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggactcaccttcagtaactatgtcatgcactgggtccgccaggctccaggcaaggggctggagtgggtggctgttatatggtatgatggaagtaataaatactatgcagactccgtgaagggccgattcaccatctccagagacaattccaagaacacgttgtatctgcaaatgaacagcctgagagccgaggacacggctgtgtattactgtgcgagagagaagtatagcagcagctggtacgactacggtatggacgtctggggccaagggaccacggtcaccgtctcctca

SEQ ID NO: 28952 - protein, 123 aa, Artificial Sequence
  Description of Artificial Sequence: Synthetic polypeptide
QVQLVESGGGVVQPGRSLRLSCAASGLTFSNYVMHWVRQAPGKGLEWVAVIWYDGSNKYYADSVKGRFTISRDNSKNTLYLQMNSLRAEDTAVYYCAREKYSSSWYDYGMDVWGQGTTVTVSS

SEQ ID NO: 28953 - DNA, 351 bp, Artificial Sequence
  Description of Artificial Sequence: Synthetic polynucleotide
caggtgcagctggtggagtctgggggaggcgtggtccagcctgggaagtccctgagactctcctgtgcagcgtctggattcaccttcagtaactatggcatgcactgggtccgccaggctccaggcaaggggctggaatgggtggcagttatttggtatgaagaaaataatcaatactatgcagactccgtgaagggccgattcaccatctccagagacaattccaagaacacgctgtatctgcaaatgaacagcctgagagccgaggacacggctgtgtattactgtgcgagagaactggggttccggtctgactactggggccagggaaccctggtcaccgtctcctca

SEQ ID NO: 28954 - protein, 117 aa, Artificial Sequence
  Description of Artificial Sequence: Synthetic polypeptide
QVQLVESGGGVVQPGKSLRLSCAASGFTFSNYGMHWVRQAPGKGLEWVAVIWYEENNQYYADSVKGRFTISRDNSKNTLYLQMNSLRAEDTAVYYCARELGFRSDYWGQGTLVTVSS

SEQ ID NO: 28955 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaaataataaatactatgtagactccgtgaagggccgattcaccatctccagagacaactccaagaacacgctgtatctgcaaatgaacagcctgagagccgaggacacggctgtatattattgtgcgagagaattggggttccggtctgactactggggccagggaaccctggtcaccgtctcctca

SEQ ID NO: 28956 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNKYYVDSVKGRFTISRDNSKNTLYLQMNSLRAEDTAVYYCARELGFRSDYWGQGTLVTVSS

SEQ ID NO: 28957 - DNA, 369 bp, Artificial Sequence; identical to SEQ ID NO: 28903
  Description of Artificial Sequence: Synthetic polynucleotide

SEQ ID NO: 28958 - protein, 123 aa, Artificial Sequence; identical to SEQ ID NO: 28904
  Description of Artificial Sequence: Synthetic polypeptide

SEQ ID NO: 28959 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgaactgggtccgccaggctccagggaaggggctggagtgggtctcagttattagtggtcgtggtggtaacacattctacgcagactccgtgaagggccggttcaccatctccagagacaattccaagaacacgctgtatctgcaaatgaacagcctgagagccgaggacacggccgtatatttctgtgcgtcccgtttggcagtggctggctcggaggcttttgatatctggggccaagggacaatggtcaccgtctcttca

SEQ ID NO: 28960 - protein, 121 aa, Artificial Sequence
  Description of Artificial Sequence: Synthetic polypeptide
EVQLLESGGGLVQPGGSLRLSCAASEFTFSSYAMNWVRQAPGKGLEWVSVISGRGGNTFYADSVKGRFTISRDNSKNTLYLQMNSLRAEDTAVYFCASRLAVAGSEAFDIWGQGTMVTVSS

SEQ ID NO: 28961 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatcgtgggagcctctggggccagggaaccctggtcaccgtctcctca

SEQ ID NO: 28962 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGSLWGQGTLVTVSS

SEQ ID NO: 28963 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgttactaataaaaagtatgcagactccgtgaagggccgattcaccatctccagagacaattccaagaacacgctgtatctgcaaatgaacagcctgacaccagagaacacgggtggatatgagaaccagagagaaaaggggggtctatttgactactggggccagggaaccctggtcaccgtctcctca

SEQ ID NO: 28964 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDVTNKKYADSVKGRFTISRDNSKNTLYLQMNSLTPENTGGYENQREKGGLFDYWGQGTLVTVSS

SEQ ID NO: 28965 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaataactatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaccagcctgagagccgaggacacggctgtgtattactgtgcgagagagaagtatagcagcaactggtacgactacggtatggacgtctggggccaagggaccacggtcaccgtctcctca

SEQ ID NO: 28966 - protein, 123 aa, Artificial Sequence
  Description of Artificial Sequence: Synthetic polypeptide
QVQLVESGGGVVQPGRSLRLSCAASGFTFNNYVMHWVRQAPGKGLEWVAVIWYDGSNKYYADSVKGRFTISRDNSKNTLYLQMTSLRAEDTAVYYCAREKYSSNWYDYGMDVWGQGTTVTVSS

SEQ ID NO: 28967 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagaaccgaggacacggctgtgtattactgtgcgagagctaacctctttgactactggggccagggaaccctggtcaccgtctcctca

SEQ ID NO: 28968 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRTEDTAVYYCARANLFDYWGQGTLVTVSS

SEQ ID NO: 28969 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggcttcatcagcaggagtacttactactggggctggatccgccagcccccagggaaggggctggagtggattgggagtatctattatagtgggagcacctcctacagcccgtccctcaagagtcgagtcaccatatccgtagacacgtccaaaaaccagttctccctgaagttgagctctgtgaccgccgcagacacggctgtgtattactgtgcgagactgaacagcagctggtcttttgactactggggccagggaaccctggtcaccgtctcctca

SEQ ID NO: 28970 - protein, 119 aa, Artificial Sequence
  Description of Artificial Sequence: Synthetic polypeptide
QLQLQESGPGLVKPSETLSLTCTVSGGFISRSTYYWGWIRQPPGKGLEWIGSIYYSGSTSYSPSLKSRVTISVDTSKNQFSLKLSSVTAADTAVYYCARLNSSWSFDYWGQGTLVTVSS

SEQ ID NO: 28971 - DNA, 351 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagcaatagcatgaactgggtccgccaggctccagggaaggggctggagtgggtttcatacattagtagtagtagtagtaccatatactacgcagactctgtgaagggccgattcaccatcgccagagacaatgccaagaactcactgtatctgcaaatgaacagcctgagagacgaggacacggctgtgtattactgtgcgagaggaggtgggagcccttttgactactggggccagggaaccctggtcaccgtctcctca

SEQ ID NO: 28972 - protein, 117 aa, Artificial Sequence
  Description of Artificial Sequence: Synthetic polypeptide
EVQLVESGGGLVQPGGSLRLSCAASGFTFSSNSMNWVRQAPGKGLEWVSYISSSSSTIYYADSVKGRFTIARDNAKNSLYLQMNSLRDEDTAVYYCARGGGSPFDYWGQGTLVTVSS

SEQ ID NO: 28973 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaaataataaatactatgtagactccgtgaagggccgattcaccatctccagagacaactccaagaacacgctgtatctgcaaatgaacagcctgagagccgaggacacggctgtgtattactgtgcgagagaattggggttccggtctgactactggggccagggaaccctggtcaccgtctcctca

SEQ ID NO: 28974 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDENNKYYVDSVKGRFTISRDNSKNTLYLQMNSLRAEDTAVYYCARELGFRSDYWGQGTLVTVSS

SEQ ID NO: 28975 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaagacacggctgtgtattactgtgcgagagagaagtatagcagcagctggtacgactacggtttggacgtctggggccaagggaccacggtcaccgtctcctca

SEQ ID NO: 28976 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVAVIWYDGSNKYYADSVKGRFTISRDNSKNTLYLQMNSLRAEDTAVYYCAREKYSSSWYDYGLDVWGQGTTVTVSS

SEQ ID NO: 28977 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtgactatggcatgcactgggtccgccaggctccaggcaaggggctggagtggatggcagttatatggtatgatgtaactaataaatactatgcagactccgtgaagggccgattcaccatctccagagacaattccaagaacacgctgtatctgcaaatgaacagcctgagagccgaggacacggctgtttattactgtgcgagagagcttggctggtacgaggactactggggccagggaaccctggtcaccgtctcctca

SEQ ID NO: 28978 - protein, 117 aa, Artificial Sequence
  Description of Artificial Sequence: Synthetic polypeptide
QVQLVESGGGVVQPGRSLRLSCAASGFTFSDYGMHWVRQAPGKGLEWMAVIWYDVTNKYYADSVKGRFTISRDNSKNTLYLQMNSLRAEDTAVYYCARELGWYEDYWGQGTLVTVSS

SEQ ID NO: 28979 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatggtggaagtaataaagactctgcagactccgtgaagggccgattcatcatctccagagacaattccaagaacacgctgtatctgcaaatgaacagcctgagagctgaggacacggctgtgtattactgtgtgagacggggatacagctatggcgggtacggtatggacgtctggggccaagggaccacggtcaccgtctcctca

SEQ ID NO: 28980 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYGGSNKDSADSVKGRFIISRDNSKNTLYLQMNSLRAEDTAVYYCVRRGYSYGGYGMDVWGQGTTVTVSS

SEQ ID NO: 28981 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcaggagtagttcctactggggctggatccgccagcccccagggaagggactggagtggattgggagtatctattatagtgggtacacctattacaccccgtccctcaagagtcgagtcaccatatccgtggacacgtccaagaaccagttctccctgaggctgagctctgtgaccgccgcagacacggcttcgtattactgtgcgagactgagcagcagttggtcttttgacttctggggccagggaaccctggtcaccgtctcctca

SEQ ID NO: 28982 - protein, 119 aa, Artificial Sequence
  Description of Artificial Sequence: Synthetic polypeptide
QLQLQESGPGLVKPSETLSLTCTVSGGSISRSSSYWGWIRQPPGKGLEWIGSIYYSGYTYYTPSLKSRVTISVDTSKNQFSLRLSSVTAADTASYYCARLSSSWSFDFWGQGTLVTVSS

SEQ ID NO: 28983 - DNA, 363 bp, Artificial Sequence
  Description of Artificial Sequence: Synthetic polynucleotide
caggtgcagttggtggagtctgggggaggcgtggtccagcctgggaggtccctgagactctcctgtgcagcctctggattcaccttcagcagctatggcatgcactgggtccgccaggctccaggcaaggggctggagtgggtggcagttatatcatatgcgggaactaatcaatactatgcagactccgtgaagggccgattcaccatttccagagacaattccaagaacacgctctatctgcaaatgaacagcctgagagctgaggacacggctgtttattattgtgtgagacggggatacagctatggcgggtacggtatggacgtctggggccaagggaccacggtcaccgtctcctca

SEQ ID NO: 28984 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYAGTNQYYADSVKGRFTISRDNSKNTLYLQMNSLRAEDTAVYYCVRRGYSYGGYGMDVWGQGTTVTVSS

SEQ ID NO: 28985 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgtcaataatatcatatggtggacgtaataatcactatgcagactccgtgaagggccgattcaccatctccagagacaattccaagaacacgctgtatctgcaaatgaacagcctgagagctgaggacacggctgtgtattactgtgtgagacggggatacagctatggcgggtacggtatggacgtctggggccaagggaccacggtcaccgtctcctca

SEQ ID NO: 28986 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVSIISYGGRNNHYADSVKGRFTISRDNSKNTLYLQMNSLRAEDTAVYYCVRRGYSYGGYGMDVWGQGTTVTVSS

SEQ ID NO: 28987 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagcagctatgtcatgaactgggtccgccaggctccagggaaggggctggagtgggtctcatccattagtggtagtagtacttacatatactgcgcagactcaatcaagggccgattcaccatctcccgagacaacgccaagaactctctgtatctgcaaatgaacagcctgagagccgatgacacggctgtgtattactgtgcgagagatcgaggctccatctggggccaagggacaatggtcaccgtctcttca

SEQ ID NO: 28988 - protein, 114 aa, Artificial Sequence
  Description of Artificial Sequence: Synthetic polypeptide
EVQLVESGGGLVKPGGSLRLSCAASGFTFSSYVMNWVRQAPGKGLEWVSSISGSSTYIYCADSIKGRFTISRDNAKNSLYLQMNSLRADDTAVYYCARDRGSIWGQGTMVTVSS

SEQ ID NO: 28989 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtaactatggcatctactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatcggggagcagtggctgcttactactactacggtatagacgtctggggccaagggaccacggtcaccgtctcctca

SEQ ID NO: 28990 - protein, 124 aa, Artificial Sequence
  Description of Artificial Sequence: Synthetic polypeptide
QVQLVESGGGVVQPGRSLRLSCAASGFTFSNYGIYWVRQAPGKGLEWVAVISYDGSNKYYADSVKGRFTISRDNSKNTLYLQMNSLRAEDTAVYYCARDRGAVAAYYYYGIDVWGQGTTVTVSS

SEQ ID NO: 28991 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcattcactgggtccgccaggctccaggcaaggggctggagtgggtggcagttatatggcatgatggaagtaataaatactatgcagactccgtgaagggccgattcaccatctccagagacaattccaagaacacgctgtatctgcaaatgaacagcctgagagccgaggacacggctgtgtattactgtgcgagagatctgagtatgggcggtatggacgtctggggccaagggaccacggtcaccgtctcctca

SEQ ID NO: 28992 - protein, 118 aa, Artificial Sequence
  Description of Artificial Sequence: Synthetic polypeptide
QVQLVESGGGVVQPGRSLRLSCAASGFTFSSYGIHWVRQAPGKGLEWVAVIWHDGSNKYYADSVKGRFTISRDNSKNTLYLQMNSLRAEDTAVYYCARDLSMGGMDVWGQGTTVTVSS

SEQ ID NO: 28993 - DNA, 363 bp, Artificial Sequence
  Description of Artificial Sequence: Synthetic polynucleotide
gaggtgcagctgttggagtctgggggaggcttggtacagcctggggggtccctgagactctcctgtgtagcctctgaattcacctttagcagctatgtcatgaactgggtccgccaggctccagggaaggggctggagtgggtctcagttattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtttggcagtggctggctcggaggcttttgatatctggggccaagggacaatggtcagcgtctcttca

SEQ ID NO: 28994 - protein, 121 aa, Artificial Sequence
  Description of Artificial Sequence: Synthetic polypeptide
EVQLLESGGGLVQPGGSLRLSCVASEFTFSSYVMNWVRQAPGKGLEWVSVISGRGGNTFYADSVKGRFTISRDNSKNTLYLQMNSLRAEDTAVYYCASRLAVAGSEAFDIWGQGTMVSVSS

SEQ ID NO: 28995 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggcatgatggaagtaataaatactatgcagactccgtgaagggccgattcaccatctccagagacaattccaagaacacgctgtatctgcaaatgaacagcctgagagccgaggacacggctgtgtattactgtgcgagagatctgagtatgggcggtatggacgtctggggccaagggaccacggtcaccgtctcctca

SEQ ID NO: 28996 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWHDGSNKYYADSVKGRFTISRDNSKNTLYLQMNSLRAEDTAVYYCARDLSMGGMDVWGQGTTVTVSS

SEQ ID NO: 28997 - DNA, 345 bp, Artificial Sequence
  Description of Artificial Sequence: Synthetic polynucleotide
gaggtgcagctgttggagtctgggggaggcttggtacagccgggggggtccctgagactctcctgtgcaacctcaggattcacctttagcagctatgtcatgagctgggtccgccaggctccagggaaggggctggagtgggtctcaggtattagtggtagtggtggtagcacaaacaacgcagactccgtgaagggccggttcaccatctccagagacaattccaagaacacgctgtatctgcaagtgaacagcctgagagccgaggacacggccgtatattactgtgcccgcagctccttgtttgactactggggccagggaaccctggtcaccgtctcctca

SEQ ID NO: 28998 - protein, 115 aa, Artificial Sequence
  Description of Artificial Sequence: Synthetic polypeptide
EVQLLESGGGLVQPGGSLRLSCATSGFTFSSYVMSWVRQAPGKGLEWVSGISGSGGSTNNADSVKGRFTISRDNSKNTLYLQVNSLRAEDTAVYYCARSSLFDYWGQGTLVTVSS

SEQ ID NO: 28999 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaagtaataaatactatgaagactccgtgaagggccgattcaccatctccagagacaattccaagaacacgctgtatctgcaaatgaacagcctgagagccgaggacacggctgtgtattactgtgtgagggaagtggggtttctttctgactactggggccagggaatcctggtcaccgtctcctca

SEQ ID NO: 29000 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDESNKYYEDSVKGRFTISRDNSKNTLYLQMNSLRAEDTAVYYCVREVGFLSDYWGQGILVTVSS

SEQ ID NO: 29001 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggatggggctggagtgggtctcagttattagtcgtagtggtggttacacatactacgcggactccgtgaagggccggttcaccatctccagagacaattccaagaacacgctgtatctgcaaatgaacagcctgagagccgaggacacggccgtctattactgtgcgtcccgtttagcagtggctggctcggaggcttttgatatctggggccaagggacaatggtcaccgtctcttca

SEQ ID NO: 29002 - protein, 121 aa, Artificial Sequence
  Description of Artificial Sequence: Synthetic polypeptide
EVQLLESGGGLVQPGGSLRLSCAASGFTFSSYAMNWVRQAPGMGLEWVSVISRSGGYTYYADSVKGRFTISRDNSKNTLYLQMNSLRAEDTAVYYCASRLAVAGSEAFDIWGQGTMVTVSS

SEQ ID NO: 29003 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaagtaataaatactatgcagactccgtgaagggccgattcaccatctccagagacaattccaagaacacgctgtatctgcaaatgaacagcctgagagccgaggacacggctgtgtattactgtgcgagggaactggggtttctctctgactactggggccagggaaccctggtcaccgtctcctca

SEQ ID NO: 29004 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDESNKYYADSVKGRFTISRDNSKNTLYLQMNSLRAEDTAVYYCARELGFLSDYWGQGTLVTVSS

SEQ ID NO: 29005 - DNA, 345 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgtcatgacctgggtccgccaggctccagggaaggggctggagtgggtctcaactattagtggtagtggtggttggacatattatgcagactccgtgaagggccggttcaccatttccagagacaattccaagaacacgctgtatctgcaaatgaacagcctgagagccgaggacacggccgaatattactgtgcccgcagctccttgtttgactattggggccagggaaccctggtcaccgtctcctca

SEQ ID NO: 29006 - protein, 115 aa, Artificial Sequence
  Description of Artificial Sequence: Synthetic polypeptide
EVQLLESGGGLVQPGGSLRLSCAASGFTFSSYVMTWVRQAPGKGLEWVSTISGSGGWTYYADSVKGRFTISRDNSKNTLYLQMNSLRAEDTAEYYCARSSLFDYWGQGTLVTVSS

SEQ ID NO: 29007 - DNA, 363 bp, Artificial Sequence
  Description of Artificial Sequence: Synthetic polynucleotide
caggtgcagctggtagagtctgggggaggcgtggtccagcctgggaggtccctgagactctcctgtgcagcctctggattcaccttcagtagctatggcatgcactgggtccgccaggctccaggcaaggggctggagtgggtggcaattatatcatatgctggaagtaataaatcctatgcagactccgtgaagggccgattcaccatctccagagacaattccaagaacatgctgtatctgcaaatgaatagcctgagagctgaggacacggctgtgtattactgtgtgagacggggatacagctatggcgggtacggtatggacgtctggggccaaggggccacggtcaccgtctcctca

SEQ ID NO: 29008 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIISYAGSNKSYADSVKGRFTISRDNSKNMLYLQMNSLRAEDTAVYYCVRRGYSYGGYGMDVWGQGATVTVSS

SEQ ID NO: 29009 - DNA, 345 bp, Artificial Sequence
  Description of Artificial Sequence: Synthetic polynucleotide
gaggtgcagttggtggagtctgggggaggcctggtcaagcctggggggtccctgagactctcctgtgtagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactgtttctgcaaatgaacagcctgagagccgaggacacggctgtgtattactgtgcgagagttaacaactttgactactggggccagggaaccctggtcaccgtctcctca

SEQ ID NO: 29010 - protein, 115 aa, Artificial Sequence
  Description of Artificial Sequence: Synthetic polypeptide
EVQLVESGGGLVKPGGSLRLSCVASGFTFSSYSMNWVRQAPGKGLEWVSSISGSSSYIYYADSVKGRFTISRDNAKNSLFLQMNSLRAEDTAVYYCARVNNFDYWGQGTLVTVSS

SEQ ID NO: 29011 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtaattatggcatgcactgggtccgccaggctccaggcaaggggctggagtgggtggcaattatatcatatgctggaagtaataaatactatgcagactccgtgaagggccgattcaccatctccagagacaattccaagaacacgctgtatctgcaaatgaacagcctgagagctgaggacacggctgtgtattactgtgtgagacgtataacagctcgtctctactacggtatggacgtctggggccaagggaccacggtcaccgtctcctca

SEQ ID NO: 29012 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAIISYAGSNKYYADSVKGRFTISRDNSKNTLYLQMNSLRAEDTAVYYCVRRITARLYYGMDVWGQGTTVTVSS

SEQ ID NO: 29013 - DNA, 357 bp, Artificial Sequence
  Description of Artificial Sequence: Synthetic polynucleotide
cagctgcagctgcaggagtcgggcccaggactggtgaggccttcggagaccctgtccctcacctgcactgtctctggtggctccatcagtaggagtagttactactggggctggatccgccagcccccaggaaaggggctggagtggattgggaatatttattatagtgggagcacctacgacaacccgtccctcaagagtcgagtcaccatatccgtagacacgtccaagaaccagttctccctgaagctgagctctgtgaccgccgcggacacggctgtttattactgtgggagacatggaaaagactggggccttgactactggggccagggaaccctggtcaccgtctcctca

SEQ ID NO: 29014 - protein, 119 aa, Artificial Sequence
  Description of Artificial Sequence: Synthetic polypeptide
QLQLQESGPGLVRPSETLSLTCTVSGGSISRSSYYWGWIRQPPGKGLEWIGNIYYSGSTYDNPSLKSRVTISVDTSKNQFSLKLSSVTAADTAVYYCGRHGKDWGLDYWGQGTLVTVSS

SEQ ID NO: 29015 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtacgagagaggtatatagcagtggctggtacgactacggtatggacgtctggggccaagggaccacggtcaccgtctcctca

SEQ ID NO: 29016 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCTREVYSSGWYDYGMDVWGQGTTVTVSS

SEQ ID NO: 29017 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgaactgggtccgccaggctccagggaaggggctggagtgggtctcagttattagtggtcgtggtattaacacattctacgcagactccgtgaagggccggttcaccatttccagagacaattccaagaacacgctgtatctgcaaatgaacagcctgagagccgaggacacggccgtatattactgtgcgtcccgtttagcagtggctggctcggaggcttttgatatctggggccaagggacaatggtcaccgtctcttca

SEQ ID NO: 29018 - protein, 121 aa, Artificial Sequence
  Description of Artificial Sequence: Synthetic polypeptide
EVQLLESGGGLVQPGGSLRLSCAASEFTFSSYAMNWVRQAPGKGLEWVSVISGRGINTFYADSVKGRFTISRDNSKNTLYLQMNSLRAEDTAVYYCASRLAVAGSEAFDIWGQGTMVTVSS

SEQ ID NO: 29019 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttactactggggctggatccgccagcccccagggatggggctggaatggattgggaatatttattatagtgggaacacctacaacaacccgtccctcaagagtcgagtcaccatatccgtagacacgtccaagaaccagttctccctgaagctgaactctgtgaccgccgcagacacggctgtgtattactgtgggagacatggaaaagactggggccttgactactggggccagggaaccctggtcatcgtctcctca

SEQ ID NO: 29020 - protein, 119 aa, Artificial Sequence
  Description of Artificial Sequence: Synthetic polypeptide
QLQLQESGPGLVKPSETLSLTCTVSGGSISRSSYYWGWIRQPPGMGLEWIGNIYYSGNTYNNPSLKSRVTISVDTSKNQFSLKLNSVTAADTAVYYCGRHGKDWGLDYWGQGTLVIVSS

SEQ ID NO: 29021 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcaattatatcatatgttggaaataataaatactatgcagactccgtgaagggccgattcaccatctccagagacaattccaagaacacgctgtatctgcaaatgaacagcctgagagttgaggacacggctgtgtattactgtgcgagacggggatacagctatggcgggtacggtatggacgtctggggccaagggaccacggtcaccgtctcctca

SEQ ID NO: 29022 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIISYVGNNKYYADSVKGRFTISRDNSKNTLYLQMNSLRVEDTAVYYCARRGYSYGGYGMDVWGQGTTVTVSS

SEQ ID NO: 29023 - DNA, 357 bp, Artificial Sequence
  Description of Artificial Sequence: Synthetic polynucleotide
cagctgcagctgcaggagtcgggcccaggactggtgaagcctgcggagaccctgtccctcacctgcactgtctctggtggctccatcagcagaagtagttactactggggctggatccgccagcccccagggaaggggctggagtggattgggagtatctattatagtgggagcacctactacaacccgtccctcaagagtcgagtcaccatatccgtggacacgtccaagaaccagttctccctgaagctgagctctgtgaccgccgcagacacggctgtgtattactgtgcgagccttagcagcagctgggacttccagcactggggccagggcaccctggtcaccgtctcctca

SEQ ID NO: 29024 - protein, 119 aa, Artificial Sequence
  Description of Artificial Sequence: Synthetic polypeptide
QLQLQESGPGLVKPAETLSLTCTVSGGSISRSSYYWGWIRQPPGKGLEWIGSIYYSGSTYYNPSLKSRVTISVDTSKNQFSLKLSSVTAADTAVYYCASLSSSWDFQHWGQGTLVTVSS

SEQ ID NO: 29025 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcaactatgccatgaactgggtccgccaggctccagggaaggggctggagtgggtctcagctattagtggtggtggtggtaacacattctacgcagactccgtgaagggccggttcaccatctccagagacaattccaagaacacgctgtatctgcaaatgaacggcctgagagccgaggacacggccgtatattactgtgcgtcccgtatagcagtggctggctcggaggcttttgctatctggggccaagggacattggtcaccgtctcttca

SEQ ID NO: 29026 - protein, 121 aa, Artificial Sequence
  Description of Artificial Sequence: Synthetic polypeptide
EVQLLESGGGLVQPGGSLRLSCAASGFTFSNYAMNWVRQAPGKGLEWVSAISGGGGNTFYADSVKGRFTISRDNSKNTLYLQMNGLRAEDTAVYYCASRIAVAGSEAFAIWGQGTLVTVSS

SEQ ID NO: 29027 - DNA, 357 bp, Artificial Sequence
  Description of Artificial Sequence: Synthetic polynucleotide
cagctgcatctgcaggagtcgggcccaggactggtgaagccttcggagaccctgtccctcacctgcactgtctctggtgcctccatcagcagaagtagttactactggggctggatccgccagcccccagggaaggggctggagtggattgggagtatttattatagtgggagcgcccagtacaacccgtccctcaagagtcgagtcaccatatccgtagacacgtccaagaaccagttctccctgacgctgagctctgtgaccgccgcagacacggctgtatattactgtgcgagactgagcagcagctggtcttttgactactggggccagggaaccctggtcaccgtctcctca

SEQ ID NO: 29028 - protein, 119 aa, Artificial Sequence
  Description of Artificial Sequence: Synthetic polypeptide
QLHLQESGPGLVKPSETLSLTCTVSGASISRSSYYWGWIRQPPGKGLEWIGSIYYSGSAQYNPSLKSRVTISVDTSKNQFSLTLSSVTAADTAVYYCARLSSSWSFDYWGQGTLVTVSS

SEQ ID NO: 29029 - DNA, 348 bp, Artificial Sequence
  Description of Artificial Sequence: Synthetic polynucleotide
gaggtgcaactggtggagtctgggggaggcttggtacagcctggggggtccctgagactctcctgtgtagtctctggattcaccttcagtagccagagcatgaactgggtccgccaggctccagggaaggggctggagtgggtctcatacattagtattagtagtaccatatactatgcagactctgtgaagggccgattcaccatctccagagacaatgccaagaactcactgtatctgcaaatgaacagcctgagagacgaggacacggctgtgtattactgtgcgagaggaggtgggagcccttttgactcctggggccagggaaccctggtcaccgtctcctca

SEQ ID NO: 29030 - protein, 116 aa, Artificial Sequence
  Description of Artificial Sequence: Synthetic polypeptide
EVQLVESGGGLVQPGGSLRLSCVVSGFTFSSQSMNWVRQAPGKGLEWVSYISISSTIYYADSVKGRFTISRDNAKNSLYLQMNSLRDEDTAVYYCARGGGSPFDSWGQGTLVTVSS

SEQ ID NO: 29031 - DNA, 357 bp, Artificial Sequence
  Description of Artificial Sequence: Synthetic polynucleotide
cagctgcagttgcaggagtcgggcccaggactggtgaagttttcggagaccctgtccctcacctgcactgtctctggtggctccatcagcagaagtagttactactggggctggatccgccagcccccagggaaggggctggagtggatagggaatatctattatagtgggtatccctactacaatccgtccctcaagagtcgagtcaccatatccgtagacacgtccaagaaccagttctccctgaagctgagctctgtgaccgccgcagacacggctgtgtattactgtgcgagacatagcaccagctggtcccttgactactggggccagggaaccctggtcaccgtctcctca

SEQ ID NO: 29032 - protein, 119 aa, Artificial Sequence
  Description of Artificial Sequence: Synthetic polypeptide
QLQLQESGPGLVKFSETLSLTCTVSGGSISRSSYYWGWIRQPPGKGLEWIGNIYYSGYPYYNPSLKSRVTISVDTSKNQFSLKLSSVTAADTAVYYCARHSTSWSLDYWGQGTLVTVSS

SEQ ID NO: 29033 - DNA, 351 bp, Artificial Sequence
  Description of Artificial Sequence: Synthetic polynucleotide
caggtgcagctggtggagtctgggggaggcgtggtccagcctgggaggtccctgagactctcctgtgaagcgtctggattcaccttcagtagctatggcatgcactgggtccgccaggctccaggcaaggggctggagtgggtggcagttatttggtatgaagaaaataatcaatactatgcagactccgtgaagggccgattcaccatctccagagacaattccaagaacacgctgtatctacaaatgaacagcctgagagccgaggacacggctgtgtattactgtgcgagagaactggggttccggtctgactactggggccagggaaccctggtcaccgtctcctca

SEQ ID NO: 29034 - protein, 117 aa, Artificial Sequence
  Description of Artificial Sequence: Synthetic polypeptide
QVQLVESGGGVVQPGRSLRLSCEASGFTFSSYGMHWVRQAPGKGLEWVAVIWYEENNQYYADSVKGRFTISRDNSKNTLYLQMNSLRAEDTAVYYCARELGFRSDYWGQGTLVTVSS

SEQ ID NO: 29035 - DNA, 339 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagattaggggactactggggccagggaaccctggtcgccgtctcctca

SEQ ID NO: 29036 - protein, 113 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLGDYWGQGTLVAVSS

SEQ ID NO: 29037 - DNA, 357 bp, Artificial Sequence
  Description of Artificial Sequence: Synthetic polynucleotide
cagctgcagctgcaggagtcgggcccaggactggtgaagccttcggagaccctgtccctcatttgtactgtctctggtggctccatcgacaggagtagttactactggggctggatccgccagcccccagggaaggggctggagtggattgggagtatctattatagtgggagcgcctatcacaacccgtccctcaagagtcgaggcaccatatccgtagatacgtccaagaaccagttctccctgaagctgagctctgtgaccgccgcagacacggctgcgtattactgtgcgagactgagcagcagctggtcctttgactactggggccagggaaccctggtcaccgtctcctct

SEQ ID NO: 29038 - protein, 119 aa, Artificial Sequence
  Description of Artificial Sequence: Synthetic polypeptide
QLQLQESGPGLVKPSETLSLICTVSGGSIDRSSYYWGWIRQPPGKGLEWIGSIYYSGSAYHNPSLKSRGTISVDTSKNQFSLKLSSVTAADTAAYYCARLSSSWSFDYWGQGTLVTVSS

SEQ ID NO: 29039 - DNA, 354 bp, Artificial Sequence
  Description of Artificial Sequence: Synthetic polynucleotide
caggtgcaggtggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaacactaacagtggtaacacaggctatgcacagaagttccagggcagagtcaccatgaccaggaacacctccataagcacagcctacatggacctgagcagcctgagatctgaggacacggccgtatattactgtgcgtatagtcatggctggttcctctttgactactggggccagggaatcctggtcaccgtctcctca

SEQ ID NO: 29040 - protein, 118 aa, Artificial Sequence
  Description of Artificial Sequence: Synthetic polypeptide
QVQVVQSGAEVKKPGASVKVSCKASGYTFTNYDINWVRQATGQGLEWMGWMNTNSGNTGYAQKFQGRVTMTRNTSISTAYMDLSSLRSEDTAVYYCAYSHGWFLFDYWGQGILVTVSS

SEQ ID NO: 29041 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtttgatggaaataataaatactatgtagattccgtgaagggccgattcaccatctccagagacaattccaagaacacgctgtttctgcaaatgaacagcctgagagccgaggacacggctgtgtattactgtgtgagagagcttgcctggtccgaggactactggggccagggaaccctggtcaccgtctcctca

SEQ ID NO: 29042 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFDGNNKYYVDSVKGRFTISRDNSKNTLFLQMNSLRAEDTAVYYCVRELAWSEDYWGQGTLVTVSS

SEQ ID NO: 29043 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgattcaccatctccagagacaacgccaagaactcactgtatctgcaaatgaacagcctgagagccgaggacacggctgtgtattactgtgcgagagtagcagcctttgactactggggccagggaaccctggtcaccgtctcctca

SEQ ID NO: 29044 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYIYYADSVKGRFTISRDNAKNSLYLQMNSLRAEDTAVYYCARVAAFDYWGQGTLVTVSS

SEQ ID NO: 29045 - DNA, 339 bp, Artificial Sequence
  Description of Artificial Sequence: Synthetic polynucleotide
gaggtgcagctggtggagtctgggggaggcctggtcaagccgggggggtccctgagactctcctgtgcagcctctggattcaccttcagtagctatagcatgaactgggtccgccaggctccagggaaggggctggagtgggtctcatccattagtagtagtaataattacatatactacgcagactcagtgaagggccgattcaccatctccagagacaacgccaagaactcactgtatctgcaaatgaacagcctgagagccgaggactcggctgtgtattactgtgcgagattaggggtctactggggccagggaaccctggtcaccgtctcctca

SEQ ID NO: 29046 - protein, 113 aa, Artificial Sequence
  Description of Artificial Sequence: Synthetic polypeptide
EVQLVESGGGLVKPGGSLRLSCAASGFTFSSYSMNWVRQAPGKGLEWVSSISSSNNYIYYADSVKGRFTISRDNAKNSLYLQMNSLRAEDSAVYYCARLGVYWGQGTLVTVSS

SEQ ID NO: 29047 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaaggggctggagtggattgggaatatctattatagtgggagcacctacaacaacccgtccctcaagagtcgagtcaccatatccgtagacacgtccaagaaccagttctccctgaagctgagctctgtgaccgccgcagacacggctgtgtattactgtgcgagacagggcagtggctgggaggttgactactggggccagggaaccctggtcaccgtctcctca

SEQ ID NO: 29048 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYNNPSLKSRVTISVDTSKNQFSLKLSSVTAADTAVYYCARQGSGWEVDYWGQGTLVTVSS

SEQ ID NO: 29049 - DNA, 357 bp, Artificial Sequence
  Description of Artificial Sequence: Synthetic polynucleotide
cagctgcagttgcaggagtcgggcccaggactggtgaagttttcggagaccctgtccctcacctgcactgtctctggtggctccatcagcagaagtagttactactggggctggatccgccagcccccagggaaggggctggagtggatagggaatatctattatagtgggtatccctactacaatccgtccctcaagagtcgagtcaccatatccatagacacgtccaagaaccagttctccctgaagctgagctctgtgaccgccgcagacacggctgtgtattactgtgcgagacatagcaccagctggtcccttgactactggggccagggaaccctggtcaccgtctcctca

SEQ ID NO: 29050 - protein, 119 aa, Artificial Sequence
  Description of Artificial Sequence: Synthetic polypeptide
QLQLQESGPGLVKFSETLSLTCTVSGGSISRSSYYWGWIRQPPGKGLEWIGNIYYSGYPYYNPSLKSRVTISIDTSKNQFSLKLSSVTAADTAVYYCARHSTSWSLDYWGQGTLVTVSS

SEQ ID NO: 29051 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctgaattcacctttagcagctatgccatgagctgggtccgccaggctccagggaaggggctggagtgggtctcaattattagtggtcgtggtggtaacacattctacgcagactccgtgaagggccggttcaccatctccagagacaattccaagaacacgctgtatctgcaaatgaacagcctgagagccgaggacacggccgtatattactgtgcgtcccgtatggcagtggctggctcggaggcttttgatatctggggccaagggacaatggtcaccgtctcttca

SEQ ID NO: 29052 - protein, 121 aa, Artificial Sequence
  Description of Artificial Sequence: Synthetic polypeptide
EVQLLESGGGLVQPGGSLRLSCAASEFTFSSYAMSWVRQAPGKGLEWVSIISGRGGNTFYADSVKGRFTISRDNSKNTLYLQMNSLRAEDTAVYYCASRMAVAGSEAFDIWGQGTMVTVSS

SEQ ID NO: 29053 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtaggagtagttactactggggctggatccgccagcccccagggaaggggctggaatggattggaaatatttattatagtgggagcacctacaccaacccgtccctcaagagtcgagtcaccatatccgtagacacgtccaagaaccacttctccctgaagctgagctctgtgaccgccgcagacacggctgtgtattactgtgggagacatggaaaagactggggccttgacaactggggccagggaaccctggtcaccgtctcctca

SEQ ID NO: 29054 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYTNPSLKSRVTISVDTSKNHFSLKLSSVTAADTAVYYCGRHGKDWGLDNWGQGTLVTVSS

SEQ ID NO: 29055 - DNA, 363 bp, Artificial Sequence
  Description of Artificial Sequence: Synthetic polynucleotide
caggtgcagctggtagagtctgggggaggcgtggtccagcctgggaggtccctgagactctcctgtgtagcctctggattcaccttcagtagctatggcatgcactgggtccgccaggctccaggcaaggggctggagtgggtggcagttatatcatatgctggaattaataaatcctatgcagactccgtgaagggccgattcaccatctccagagacaattccaataacacgctgtatctgcaaatgaacagcctgagagctgaggacacggctgtgtattactgtgtgagacggggatacagctatggcgggtatggtatggacgtctggggccaaggggccacggtcaccgtctcctca

SEQ ID NO: 29056 - protein, 121 aa, Artificial Sequence
  Description of Artificial Sequence: Synthetic polypeptide
QVQLVESGGGVVQPGRSLRLSCVASGFTFSSYGMHWVRQAPGKGLEWVAVISYAGINKSYADSVKGRFTISRDNSNNTLYLQMNSLRAEDTAVYYCVRRGYSYGGYGMDVWGQGATVTVSS

SEQ ID NO: 29057 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggcatgatggaagtaataaatactatgtagactccgtgaagggccgattcaccatctccagagacaattccaagaacacgctgaatctgcaaatgaacagcctgagagccgaggacacggctgtgtattactgtgcgagagatctgagtatgggcggtatggacgtctggggccaagggaccacggtcaccgtctcctca

SEQ ID NO: 29058 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWHDGSNKYYVDSVKGRFTISRDNSKNTLNLQMNSLRAEDTAVYYCARDLSMGGMDVWGQGTTVTVSS

SEQ ID NO: 29059 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccgctggacaagggcttgagtggatgggatggatgcaccctaacagtggtaacacaggctatgcacagaagttccagggcagagtcaccatgaccaggaacacctccagaagcacagcctacatggagctgagcagcctgagatctgaggacacggccgtgtactactgtgcgtatagcagtggctggtacttctttgactactggggccagggaaccctggtcaccgtctcctca

SEQ ID NO: 29060 - protein, 118 aa, Artificial Sequence
  Description of Artificial Sequence: Synthetic polypeptide
QVQLVQSGAEVKKPGASVKVSCKASGYTFTNYDINWVRQAAGQGLEWMGWMHPNSGNTGYAQKFQGRVTMTRNTSRSTAYMELSSLRSEDTAVYYCAYSSGWYFFDYWGQGTLVTVSS

SEQ ID NO: 29061 - DNA, 363 bp, Artificial Sequence
  Description of Artificial Sequence: Synthetic polynucleotide
gaggtgcagctgttggagtctgggggagacttggttcagcctggggggtccctgagactctcctgtgcagcctctgaattcacctttagcagctatgccatgagctgggtccgccaggctccagggaaggggctggagtggatctcagttattagtggtcgtggtgttaacacattctacgcagactccgtgaagggccggttcaccatctccagagacaattccaagaacacgctctatctacaaatgaacagcctgagagccgaggacacggccgtatattactgtgcgtcccgtatcgcagtggctggctcggaggcttttgatatctggggccaagggacaatggtcaccgtctcttca

SEQ ID NO: 29062 - protein, 121 aa, Artificial Sequence
  Description of Artificial Sequence: Synthetic polypeptide
EVQLLESGGDLVQPGGSLRLSCAASEFTFSSYAMSWVRQAPGKGLEWISVISGRGVNTFYADSVKGRFTISRDNSKNTLYLQMNSLRAEDTAVYYCASRIAVAGSEAFDIWGQGTMVTVSS

SEQ ID NO: 29063 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtgacagttatatggtatgatgaaagtaataaatactatgcagactccgtgaagggccgattcaccatctccagagacgattccaaaaacacgctgtatctgcaaatgaacagtctgagagccgaggacacggctgtgtattactgtgcgagagagcttgcctggtacgaggactactggggccagggaaccctggtcaccgtctcctca

SEQ ID NO: 29064 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVTVIWYDESNKYYADSVKGRFTISRDDSKNTLYLQMNSLRAEDTAVYYCARELAWYEDYWGQGTLVTVSS

SEQ ID NO: 29065 - DNA, 351 bp, Artificial Sequence
  Description of Artificial Sequence: Synthetic polynucleotide
caggtgcagctggtggagtctgggggaggcctggtccagcctgggaggtccctgagactctcctgtgcagcgtctggattcaccttcagtagctatggcatgcactgggtccgccaggctccaggcaaggggctggagtgggtggcagttatttggtatgaggaaagtaataaatactatgtagactccgtgaggggccgattcaccatctccagagacaattccaagagcacgctgtatctgcaaatgaacagcctgagagccgaggacacggctgtgtattactgtgtgagagaactaggcttccagtctgacttctggggccagggaaccccggtcaccgtctcctca

SEQ ID NO: 29066 - protein, 117 aa, Artificial Sequence
  Description of Artificial Sequence: Synthetic polypeptide
QVQLVESGGGLVQPGRSLRLSCAASGFTFSSYGMHWVRQAPGKGLEWVAVIWYEESNKYYVDSVRGRFTISRDNSKSTLYLQMNSLRAEDTAVYYCVRELGFQSDFWGQGTPVTVSS

SEQ ID NO: 29067 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatggaaataataattactatgcagactccgtgaagggccgattcaccatctccagagacaattccaagaacacgctgtatctgcaaatgaacagcctgagagccgaggacacggctgtgtattactgtgcgagagagcttgcctggtacgaggacttctggggccagggaaccctggtcaccgtctcctca

SEQ ID NO: 29068 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDGNNNYYADSVKGRFTISRDNSKNTLYLQMNSLRAEDTAVYYCARELAWYEDFWGQGTLVTVSS

SEQ ID NO: 29069 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgtaagtaataaatactatgcagactccgtgaagggccgattcaccatctccagagacaattccaagaacatgttgtatctgcaaatgaacagcctgagagccgaggacacggctgtgtattactgtgcgcgagaaatgggctggaccgatgactgctggggccagggaaccctggtcaccgtctcctca

SEQ ID NO: 29070 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDVSNKYYADSVKGRFTISRDNSKNMLYLQMNSLRAEDTAVYYCAREMGWTDDCWGQGTLVTVSS

SEQ ID NO: 29071 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcactgactatggcatgcactgggtccgccaggctccaggcaaggggctggagtgggtggcagttatttggtatgatgaaaataatgaatactatgcagactccgtgaagggccgattcaccatctccagagccaattccaagaacacgctgtatctgcaaatgaacagcctgagagccgaggacacggctgtgtattactgtgcgagagagcttgcctggtacgaggactactggggccagggaaccctggtcaccgtctcctca

SEQ ID NO: 29072 - protein, 117 aa, Artificial Sequence
  Description of Artificial Sequence: Synthetic polypeptide
QVQLVESGGGVVQPGRSLRLSCAASGFTFTDYGMHWVRQAPGKGLEWVAVIWYDENNEYYADSVKGRFTISRANSKNTLYLQMNSLRAEDTAVYYCARELAWYEDYWGQGTLVTVSS

SEQ ID NO: 29073 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgtacagaagtttcagggcagggtcaccatgaccagggacacgtccatcagcacagcctgcatggagctgagcaggctgaaatctgacgacacggccgtgtatttctgtgcgaggtcgtttttctatggttcggggagttattataacgaatttgactactggggccagggaaccctggtcaccgtctcctca

SEQ ID NO: 29074 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYVQKFQGRVTMTRDTSISTACMELSRLKSDDTAVYFCARSFFYGSGSYYNEFDYWGQGTLVTVSS

SEQ ID NO: 29075 - DNA, 372 bp, Artificial Sequence
  Description of Artificial Sequence: Synthetic polynucleotide
gaggtgcagctgttggagtctgggggaggcttgatacagcctggggggtccctgagactctcctgtgcagcctctggattcacctttagtagctatgtcatgagctgggtccgccaggctccagggaaggggctggagtgggtctccactattagtgttggtggtggtaccacatactacgcagactccgtgaagggccggttcaccatctccagagacaattccaagaatacgctgtatctgcaaatgaacagcctgagagccgaggacacggccgtatattactgtgcgaaatggggacgtggcaacagctatgagtactactacggtatggacgtctggggccaagggaccacggtcaccgtctcctca

SEQ ID NO: 29076 - protein, 124 aa, Artificial Sequence
  Description of Artificial Sequence: Synthetic polypeptide
EVQLLESGGGLIQPGGSLRLSCAASGFTFSSYVMSWVRQAPGKGLEWVSTISVGGGTTYYADSVKGRFTISRDNSKNTLYLQMNSLRAEDTAVYYCAKWGRGNSYEYYYGMDVWGQGTTVTVSS

SEQ ID NO: 29077 - DNA, 360 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagaagctatgccatgagctgggtccgccaggctccagggaaggggctggagtgggtctcagttattagtggtagtggtggtaacacatacttcgcagactccgtgaagggccggttcaccatctccagagacaattccaagaacacgctgtatctgcaaatggacagcctgagagccgaggacacggccgtatattactgtgcgaaaaggggtataccagaggctgatgcttttgatatctggggccaagggacaatggtcactgtctcttca

SEQ ID NO: 29078 - protein, 120 aa, Artificial Sequence
  Description of Artificial Sequence: Synthetic polypeptide
EVQLLESGGGLVQPGGSLRLSCAASGFTFRSYAMSWVRQAPGKGLEWVSVISGSGGNTYFADSVKGRFTISRDNSKNTLYLQMDSLRAEDTAVYYCAKRGIPEADAFDIWGQGTMVTVSS

SEQ ID NO: 29079 - DNA, 369 bp, Artificial Sequence
  Description of Artificial Sequence: Synthetic polynucleotide
gaggtgcagctgttggagtctgggggaggcttggaacagccgggggggtccctgagactctcctgtgcagcctctggattcacctttagcagctatgccatgagctgggtccgccaggctccagggaaggggctggagtgggtctcagttattagtggtagtggtggtaccacattctacgcagactccgtgaagggccggttcaccatctccagagacaattccaagaacacgctgtatctgcaaatgagcagcctgagagccgaggacacggccgtatatttctgtgcccgatattgtagtagtaccaggtgtccttatgatgcctttgatatctggggccaagggacaatggtcaccgtctcctca

SEQ ID NO: 29080 - protein, 123 aa, Artificial Sequence
  Description of Artificial Sequence: Synthetic polypeptide
EVQLLESGGGLEQPGGSLRLSCAASGFTFSSYAMSWVRQAPGKGLEWVSVISGSGGTTFYADSVKGRFTISRDNSKNTLYLQMSSLRAEDTAVYFCARYCSSTRCPYDAFDIWGQGTMVTVSS

SEQ ID NO: 29081 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatgtactacgcagactcagtgaagggccgattcaccatctccagagacaacgccaagaactcactgtatctgcaaatgaacagcctgcgagccgaggacacggctctgtattactgtgcgagagatcgtgggagctcctggggccagggaaccctggtcaccgtctcctca

SEQ ID NO: 29082 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYMYYADSVKGRFTISRDNAKNSLYLQMNSLRAEDTALYYCARDRGSSWGQGTLVTVSS

SEQ ID NO: 29083 - DNA, 360 bp, Artificial Sequence
  Description of Artificial Sequence: Synthetic polynucleotide
caggtgcagttggtgcagtctggggctgaggtgaagaagcctggggcctcagtgaaggtctcctgcaagacttctggatacaccttcaccgactattatatgcactgggtgcgacaggcccctggacaagggcttgagtggatgggatggatcaaccctaacagtggtggcacaaactatgaacagaagtttcagggcagggtcaccatgaccagggacacgtccatcagcacagcctacatggaactgagtaggctgagatctgacgacacggccgtgtattactgtgcgagtggatacagctatgggtacaactggttcgacccctggggccagggaaccctggtcaccgtctcctca

SEQ ID NO: 29084 - protein, 120 aa, Artificial Sequence
  Description of Artificial Sequence: Synthetic polypeptide
QVQLVQSGAEVKKPGASVKVSCKTSGYTFTDYYMHWVRQAPGQGLEWMGWINPNSGGTNYEQKFQGRVTMTRDTSISTAYMELSRLRSDDTAVYYCASGYSYGYNWFDPWGQGTLVTVSS

SEQ ID NO: 29085 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggagggggctggagtgggtctcatccattagtggtagtagtagttacatatactacgcagactcagtgaagggccgattcaccatcttcagagacaacgccaagaactcactgtatctgcaaatgaacagcctgagagccgaggacacggctgtgtattactgtgcgagagtggcttcatttgactactggggccagggaaccctggtcaccgtctcctca

SEQ ID NO: 29086 - protein, 115 aa, Artificial Sequence
  Description of Artificial Sequence: Synthetic polypeptide
EVQLVESGGGLVKPGGSLRLSCAASGFTFSSYSMNWVRQAPGRGLEWVSSISGSSSYIYYADSVKGRFTIFRDNAKNSLYLQMNSLRAEDTAVYYCARVASFDYWGQGTLVTVSS

SEQ ID NO: 29087 - DNA, 351 bp, Artificial Sequence
  Description of Artificial Sequence: Synthetic polynucleotide
caggtgcaactggtgcagtctggggctgaggtgaagaagcctggggcctccgtgaaggtctcctgcaaggcttctggatacaccttcaccggctactatttgcactgggtgcgacaggcccctggacaagggcttgagtggctgggatggatcaaccctaacagtaatggcacaatctctgcacagaagtttcagggcagggtcaccatgaccagggacacgtccatcagcacagcctacatggagctgagcaggctgatatctgacgacacggccgtatattactgtgcgagagatggtaccagctcgcttgactactggggccagggaaccctggtcaccgtctcctca

SEQ ID NO: 29088 - protein, 117 aa, Artificial Sequence
  Description of Artificial Sequence: Synthetic polypeptide
QVQLVQSGAEVKKPGASVKVSCKASGYTFTGYYLHWVRQAPGQGLEWLGWINPNSNGTISAQKFQGRVTMTRDTSISTAYMELSRLISDDTAVYYCARDGTSSLDYWGQGTLVTVSS

SEQ ID NO: 29089 - DNA, 360 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaatcctaacagtggtggcacaaactatgcacagaagtttcagggcagggtcaccatgaccagggacacgtccatcagcacagcctacatggagctgagcaggctgagatctgacgacacggccgtgtattactgtgcgagtggatacagctatgggtacaactggttcgacccctggggccagggaaccctggtcaccgtctcctca

SEQ ID NO: 29090 - protein, 120 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCASGYSYGYNWFDPWGQGTLVTVSS

SEQ ID NO: 29091 - DNA, 390 bp, Artificial Sequence
  Description of Artificial Sequence: Synthetic polynucleotide
gaggtgcagctggtggagtctgggggaggcttggtgaagcctggggggtcccttagactctcctgtgcagcctctggattcactttcagtaacgcctggatgaactgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatacgggtcctatagcagctcgtctcgcttactactactattacgctatggacgtctggggccacgggaccacggtcaccgtctcctca

SEQ ID NO: 29092 - protein, 130 aa, Artificial Sequence
  Description of Artificial Sequence: Synthetic polypeptide
EVQLVESGGGLVKPGGSLRLSCAASGFTFSNAWMNWVRQAPGKGLEWVGRIKSKTDGGTTDYAAPVKGRFTISRDDSKNTLYLQMNSLKTEDTAVYYCTTDTGPIAARLAYYYYYAMDVWGHGTTVTVSS

SEQ ID NO: 29093 - DNA, 372 bp, Artificial Sequence
  Description of Artificial Sequence: Synthetic polynucleotide
caggtgcagctggtgcagtctggggctgaggtgaagaaacctggggcctcagtgaaggtctcctgcaaggcttctggatacaccttcaccgactactatattcactgggtgcgacaggcccctggacaagggcttgagtggatgggatggatcaaccctaacagtggtgggacaaacaatgcacagaagtttcagggcagggtcaccatgaccagggacacgtccatcagtacagcctacatggagctgagcaggctgagatctgacgatacggccgtgtattcctgtgcgaggtcgtattactatggttcggggacttattataacgaatttgactactggggccagggaaccctggtcaccgtctcctca

SEQ ID NO: 29094 - protein, 124 aa, Artificial Sequence
  Description of Artificial Sequence: Synthetic polypeptide
QVQLVQSGAEVKKPGASVKVSCKASGYTFTDYYIHWVRQAPGQGLEWMGWINPNSGGTNNAQKFQGRVTMTRDTSISTAYMELSRLRSDDTAVYSCARSYYYGSGTYYNEFDYWGQGTLVTVSS

SEQ ID NO: 29095 - DNA, 372 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctcttagtggtcgtggtggtagcacatactacgcagactccgtgaagggccggttcaccatctccagagacaattccaagaacacgctgtatctgcaaatgaacagcctgagagccgaggacacggccgtatattactgtgcgaaatggggacgtggatacagctatgagtactactacggtatggacgtctggggccaagggaccacggtcaccgtctcctca

SEQ ID NO: 29096 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSALSGRGGSTYYADSVKGRFTISRDNSKNTLYLQMNSLRAEDTAVYYCAKWGRGYSYEYYYGMDVWGQGTTVTVSS

SEQ ID NO: 29097 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcataaattatgatatcaactgggtgcgacaggccactggacaagggcttgagtggatgggatggatgcaccctgacagtggtaacacaggctatgcacagaagttccagggcagagtcaccatgaccaggaacacctccataagcacagcctacatggagctgagcagtttgagatctgaggacacggccgtgtattattgtgcgtatagtagtggctggtactactttgactactggggccagggaaccctggtcaccgtctcctca

SEQ ID NO: 29098 - protein, 118 aa, Artificial Sequence
  Description of Artificial Sequence: Synthetic polypeptide
QVQLVQSGAEVKKPGASVKVSCKASGYTFINYDINWVRQATGQGLEWMGWMHPDSGNTGYAQKFQGRVTMTRNTSISTAYMELSSLRSEDTAVYYCAYSSGWYYFDYWGQGTLVTVSS

SEQ ID NO: 29099 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactggtggagtgggtgtgggctggatccgtcagcccccaggaaaggccctggagtggcttgcactcatttattggaatgatgataagcgctacagcccatctctgaagagcaggctcaccatcaccagggacacctccaaaaaccaggtggtccttacaatgaccaacatggaccctgtggacacagccacatattactgtgcacacactatagcagttcgtggctttgactactggggccagggaaccctggtcaccgtctcctca

SEQ ID NO: 29100 - protein, 119 aa, Artificial Sequence
  Description of Artificial Sequence: Synthetic polypeptide
QITLKESGPTLVKPTQTLTLTCTFSGFSLSTGGVGVGWIRQPPGKALEWLALIYWNDDKRYSPSLKSRLTITRDTSKNQVVLTMTNMDPVDTATYYCAHTIAVRGFDYWGQGTLVTVSS

SEQ ID NO: 29101 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgaactggatccgccaggctccagggaaggggctggagtgggtctcatccattagtggtagtagtacttacatatactacgcagactcagtgaagggccgaatcgccatctccagagacaacgccaagaactcactgtatctgcaaatgaacagcctgagagccgaggacacggctgtgtattactgtgcgagagtggcttcatttgactactggggccagggaaccctggtcaccgtctcctca

SEQ ID NO: 29102 - protein, 115 aa, Artificial Sequence
  Description of Artificial Sequence: Synthetic polypeptide
EVQLVESGGGLVKPGGSLRLSCAASGFTFSSYSMNWIRQAPGKGLEWVSSISGSSTYIYYADSVKGRIAISRDNAKNSLYLQMNSLRAEDTAVYYCARVASFDYWGQGTLVTVSS

SEQ ID NO: 29103 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatctgcactgggtgcgacaggcccctggacaagggcttgagtggatgggatggatcaaccctaacaataatggcacaaactatgcacagaagtttcagggcagggtcaccatgaccagggacacgtccatcagcacagcctacatggagctgagccggctgagatctgacgacacggccgtgtattactgtgcgagagatggtaccagctcgtttgactactggggccagggaaccctggtcaccgtctcctca

SEQ ID NO: 29104 - protein, 117 aa, Artificial Sequence
  Description of Artificial Sequence: Synthetic polypeptide
QVQLVQSGAEVKKPGASVKVSCKASGYTFTGYYLHWVRQAPGQGLEWMGWINPNNNGTNYAQKFQGRVTMTRDTSISTAYMELSRLRSDDTAVYYCARDGTSSFDYWGQGTLVTVSS

SEQ ID NO: 29105 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtgcctttcactcatttattggaataatgataaggtctacagcccatctctgaagagcaggctcaccatcaccaagtacacctccaaaaaccaggtggtccttacaatgtccaacatggaccctgtggacacagccacatattactgtgcacacaggggacagcagctggccctcgactactggggccagggaaccctggtcaccgtctcctca

SEQ ID NO: 29106 - protein, 119 aa, Artificial Sequence
  Description of Artificial Sequence: Synthetic polypeptide
QITLKESGPTLVKPTQTLTLTCTFSGFSLSTSGVGVGWIRQPPGKALECLSLIYWNNDKVYSPSLKSRLTITKYTSKNQVVLTMSNMDPVDTATYYCAHRGQQLALDYWGQGTLVTVSS

SEQ ID NO: 29107 - DNA, 354 bp, Artificial Sequence
  Description of Artificial Sequence: Synthetic polynucleotide
caggtgcagctgctgcagtctggggctgaggtgaagaagcctggggcctcagtgaaggtctcctgcaaggcttctggatacaccttcaccaattatgatatcaactgggtgcgacaggccactggacaagggcttgagtggatgggatggatgtaccctaacagtggtaacacgggctatgcacagaagttccagggcagagtcaccatgaccatgaacacctccataagcacagcctacatggagttgagcagcctgagatctgaggacacggccgtgtattactgtgcgattagcggtggctggtactactttgactactggggccagggaaccctggtcaccgtctcctct

SEQ ID NO: 29108 - protein, 118 aa, Artificial Sequence
  Description of Artificial Sequence: Synthetic polypeptide
QVQLLQSGAEVKKPGASVKVSCKASGYTFTNYDINWVRQATGQGLEWMGWMYPNSGNTGYAQKFQGRVTMTMNTSISTAYMELSSLRSEDTAVYYCAISGGWYYFDYWGQGTLVTVSS

SEQ ID NO: 29109 - DNA, 372 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtggtagcacatactacgcagactccgtgaagggccggttcaccatctccagagacaattccaagaacacgctgtatctgcaaatgaacagcctgagagccgaggacacggccgtatattactgtgcgaaatggggacgtggatacagctatgagtactactacggtatggacgtctggggccaggggaccacggtcaccgtctcctca

SEQ ID NO: 29110 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTYYADSVKGRFTISRDNSKNTLYLQMNSLRAEDTAVYYCAKWGRGYSYEYYYGMDVWGQGTTVTVSS

SEQ ID NO: 29111 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacatcttcaccaattatgatatcaactgggtgcgacaggccactggacaagggcttgagtggatgggatggatgcaccctaacagtggtaacacaggctatgcacagaagttccagggcagagtcaccatgacctggaacacctccataagcacagccaacatggagctgagcagcctgagatctgaggacacggccgtgtattactgtgcgagtagcagtggctggtattggttcgacccctggggccagggaaccctggtcaccgtctcctca

SEQ ID NO: 29112 - protein, 118 aa, Artificial Sequence
  Description of Artificial Sequence: Synthetic polypeptide
QVQLVQSGAEVKKPGASVKVSCKASGYIFTNYDINWVRQATGQGLEWMGWMHPNSGNTGYAQKFQGRVTMTWNTSISTANMELSSLRSEDTAVYYCASSSGWYWFDPWGQGTLVTVSS

SEQ ID NO: 29113 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacctggagctgagcagcctgagatctgaggacacggccgtgtattactgtgcggggagcaatggctggtactactttgactactggggccagggaaccctggtcaccgtctcctca

SEQ ID NO: 29114 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYLELSSLRSEDTAVYYCAGSNGWYYFDYWGQGTLVTVSS

SEQ ID NO: 29115 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgaatggatgggatggatgcaccctaacagtggtaacacaggctgtgcacagaagttccagggcagagtcaccatgacctggaacatgtccataagcacagcctacatggagctgagcagcctgagatctgaggacacggccgtatattactgtgcgagtagcagtggctggtactggttcgacccctggggccagggaaccctggtcaccgtctcctca

SEQ ID NO: 29116 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGCAQKFQGRVTMTWNMSISTAYMELSSLRSEDTAVYYCASSSGWYWFDPWGQGTLVTVSS

SEQ ID NO: 29117 - DNA, 351 bp, Artificial Sequence
  Description of Artificial Sequence: Synthetic polynucleotide
caggtgcagttggtgcagtctgggactgaggtgaagaagcctggggcctcagtgaaggtctcctgcaaggcttctggatacaccttcaccggcgattatatgcactgggtgcgacaggcccctggacaagggcttgagtggatgggatggatcagccctaaaaatggtggcacaaactatgcacagaagtttcagggcagggtcaccatgaccagggacacgtccatcagcacagtctacatggagctgaacaggctgagatctgacgacacggccgtgtattactgtgcgagagatggaactgggtcctttgactactggggccagggaaccctagtcaccgtctcctca

SEQ ID NO: 29118 - protein, 117 aa, Artificial Sequence
  Description of Artificial Sequence: Synthetic polypeptide
QVQLVQSGTEVKKPGASVKVSCKASGYTFTGDYMHWVRQAPGQGLEWMGWISPKNGGTNYAQKFQGRVTMTRDTSISTVYMELNRLRSDDTAVYYCARDGTGSFDYWGQGTLVTVSS

SEQ ID NO: 29119 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaactatgatattaactgggtgcgacaggccactggacaagggcttgagtggatgggatggatgaaccctaacagtggtaacacaggctatgcacagaagttccagggccgagtcaccatgaccaggaacacctccataagcacagcctacatggagctgagcagcctgagatctgaggacacggccgtgtattactgtgcgagcagcagtggctggtacttttttgactactggggccagggaaccctggtcaccgtctcctca

SEQ ID NO: 29120 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYFFDYWGQGTLVTVSS

SEQ ID NO: 29121 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgacatcaactgggtgcgacaggccactggacaagggcttgagtggatgggatggatgcaccctaacagtggtaacacaggctttgcacagaagttccggggcagagtcaccatgaccagaaacacctccataagcacagcctacatggaactgagcagcctgagatctgaggacacggccgtgtattactgttcgagcagcagtggctggtacttttttgactactggggccagggaaccctggtcaccgtctcctca

SEQ ID NO: 29122 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGFAQKFRGRVTMTRNTSISTAYMELSSLRSEDTAVYYCSSSSGWYFFDYWGQGTLVTVSS

SEQ ID NO: 29123 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgattcaccatctccagagacaacgccaagaactcactgtatctgcaaatgaacagcctgagagccgaggacacggctgtgtattactgtgcgagagtggctggctttgactactggggccagggaaccctggtcaccgtctcctca

SEQ ID NO: 29124 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYIYYADSVKGRFTISRDNAKNSLYLQMNSLRAEDTAVYYCARVAGFDYWGQGTLVTVSS

SEQ ID NO: 29125 - DNA, 369 bp, Artificial Sequence
  Description of Artificial Sequence: Synthetic polynucleotide
gaggtgcagctgttggagtctgggggaggcttggcacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcacgatctccagagacaattccaagaacacgctgtatctgcaaatgaacagcctgagagccgaggacacggccgtatattactgtgtgaaaggggagctactagaggactactacttctacggtatggacgtctggggccaagggaccacggtcaccgtctcctca

SEQ ID NO: 29126 - protein, 123 aa, Artificial Sequence
  Description of Artificial Sequence: Synthetic polypeptide
EVQLLESGGGLAQPGGSLRLSCAASGFTFSSYAMSWVRQAPGKGLEWVSAISGRGGSTFHADSVKGRFTISRDNSKNTLYLQMNSLRAEDTAVYYCVKGELLEDYYFYGMDVWGQGTTVTVSS

SEQ ID NO: 29127 - DNA, 345 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgcgaaagaaggctaacgactactggggccagggaaccctggtcaccgtctcctca

SEQ ID NO: 29128 - protein, 115 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARKKANDYWGQGTLVTVSS

SEQ ID NO: 29129 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataacatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtattactgtgcgaggttaaatggttttgactactggggccagggaaccctggtcaccgtctcctca

SEQ ID NO: 29130 - protein, 115 aa, Artificial Sequence
  Description of Artificial Sequence: Synthetic polypeptide
EVQLVESGGGLVKPGGSLRLSCAASGFTFSSYNMNWVRQAPGKGLEWVSSISGSSSYIYYADSVKGRFTISRDNAKNSLYLQMNSLRAEDTAVYYCARLNGFDYWGQGTLVTVSS

SEQ ID NO: 29131 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccgctattagtggtcgtggtggtagcacattccacgcagactccgtgaagggccggttcaccatctccagagacaattccaagaacacgctgtatctgcaaatgaacagcctgagagccgaggacacggccgtatattactgtgtgaaaggggagctactagaggactactacttctacggtatggacgtctggggccaagggaccacggtcaccgtctcctca

SEQ ID NO: 29132 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGSTFHADSVKGRFTISRDNSKNTLYLQMNSLRAEDTAVYYCVKGELLEDYYFYGMDVWGQGTTVTVSS

SEQ ID NO: 29133 - DNA, 345 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcagctgggtgcgactggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaaagagggctaacgactactggggccagggaaccctggtcaccgtctcctca

SEQ ID NO: 29134 - protein, 115 aa, Artificial Sequence
  Description of Artificial Sequence: Synthetic polypeptide
QVQLVQSGAEVKKPGASVKVSCKASGYTFTSYDISWVRLATGQGLEWMGWMNPNSGNTGYAQKFQGRVTMTRNTSISTAYMELSSLRSEDTAVYYCARKRANDYWGQGTLVTVSS

SEQ ID NO: 29135 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaactatgatattaactgggtgcgacaggccactggacaagggcttgagtggatgggatggatgaaccctaacagtggtaacacaggctatgcacagaagttccagggcagagtcaccatgaccaggaacacctccataagcacagcctacatggagctgaacagcctgagatctgaggacacggccgtgtattactgtgcgagcagcagtggctggtacttttttgactactggggccagggaaccctggtcaccgtctcctca

SEQ ID NO: 29136 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELNSLRSEDTAVYYCASSSGWYFFDYWGQGTLVTVSS

SEQ ID NO: 29137 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctccactattagtggtcgtggtggtagcacattccacgcagactccgtgaagggccggttcaccatctccagagacaattccaagaacacgctgtatctgcaaatgaacagcctgagagccgaagacacggccgtatattactgtgtgaaaggggagctactagaggactactacttctacggtatggacgtctggggccaagggaccacggtcaccgtctcctca

SEQ ID NO: 29138 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSTISGRGGSTFHADSVKGRFTISRDNSKNTLYLQMNSLRAEDTAVYYCVKGELLEDYYFYGMDVWGQGTTVTVSS

SEQ ID NO: 29139 - DNA, 390 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtaacgcccggatgaactgggtccgcctggctccagggaaggggctggagtgggttggccgtattaaaagcaaaactgatggtgggacaacagactacgctgcacccgtgaaaggcagattcaccatctcaagagatgaatcagaaaacacgctgtatctgcaaatgaacagcctgaaaaccgaggacacaggtgtgtattactgttccacagatacgggtcctatagcagctcgtctcgcttactactactactacgctatggacgtctggggccaagggaccacggtcaccgtctcctca

SEQ ID NO: 29140 - protein, 130 aa, Artificial Sequence
  Description of Artificial Sequence: Synthetic polypeptide
EVQLVESGGGLVKPGGSLRLSCAASGFTFSNARMNWVRLAPGKGLEWVGRIKSKTDGGTTDYAAPVKGRFTISRDESENTLYLQMNSLKTEDTGVYYCSTDTGPIAARLAYYYYYAMDVWGQGTTVTVSS

SEQ ID NO: 29141 - DNA, 360 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcaccactagtggagtgggtgtgggctggatccgtcagcccccaggaaaggccctggaatggcttgcactcatttattggagtgatgataagcgctacagcccatctctgaagagcaggctcaccatcaccaaggacacctccaaaaaccaggtggtccttacaatgaccaacatggcccctgtggacacagccacatattactgtgcacacaccggttctagctgctgctattttgactactggggccagggaaccctggtcaccgtctcctca

SEQ ID NO: 29142 - protein, 120 aa, Artificial Sequence
  Description of Artificial Sequence: Synthetic polypeptide
QITLKESGPTLVKPTQTLTLTCTFSGFSLTTSGVGVGWIRQPPGKALEWLALIYWSDDKRYSPSLKSRLTITKDTSKNQVVLTMTNMAPVDTATYYCAHTGSSCCYFDYWGQGTLVTVSS

SEQ ID NO: 29143 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaaataataaatactatgtagactccgtgaagggccgattcaccatctccagagacaactccaagaacacgctgtatctgcaaatgaacagcctgagagccgaggacacggctgtgtattactgtgcgagagaattggggttccggtctgactactggggccagggaaccctggtcaccgtctcctca

SEQ ID NO: 29144 - protein, 117 aa, Artificial Sequence; identical to SEQ ID NO: 28414
  Description of Artificial Sequence: Synthetic polypeptide

SEQ ID NO: 29145 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatgtactacgcagactcagtgaagggccgattcaccatctccagagacaacgccaaggactcactgtatctgcaaatgaacagcctgagagccgaggacacggctgtgtattactgtgcgagagtgaatctctttgactactggggccagggaaccctggtcaccgtctcctca

SEQ ID NO: 29146 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYMYYADSVKGRFTISRDNAKDSLYLQMNSLRAEDTAVYYCARVNLFDYWGQGTLVTVSS

SEQ ID NO: 29147 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactatcatatgcactgggtgcgacaggcccctggacaagggcttgagtggatgggatggatcaaccctaataggggtggcacaaactatgcacagaagtttcaggacagggtcaccatgaccagggacacgtccatcagcacagcctacatggaactgagcaggctgagatctgacgacacggccgtctatttctgtgcgagagatggaactgggtcctttgactactggggccagggaaccctggtcaccgtctcctca

SEQ ID NO: 29148 - protein, 117 aa, Artificial Sequence
  Description of Artificial Sequence: Synthetic polypeptide
QVQLVQSGAEVKKPGASVKVSCKASGYTFTDYHMHWVRQAPGQGLEWMGWINPNRGGTNYAQKFQDRVTMTRDTSISTAYMELSRLRSDDTAVYFCARDGTGSFDYWGQGTLVTVSS

SEQ ID NO: 29149 - DNA, 339 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgcgtctggggaactactggggccagggaaccctggtcaccgtctcctca

SEQ ID NO: 29150 - protein, 113 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLGNYWGQGTLVTVSS

SEQ ID NO: 29151 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtattactgtgcgagagtcaacggtatggacgtctggggccaagggaccacggtcaccgtctcctca

SEQ ID NO: 29152 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARVNGMDVWGQGTTVTVSS

SEQ ID NO: 29153 - DNA, 390 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtaacgcctggatgaactgggtccgcctggctccagggaaggggctggagtgggttggccgtattaaaagcaaaactgatggtgggacaacagactacgctgcacccgtgaaaggcagattcaccatctcaagagatgattcagaaaacacgttgtatctgcaaatgaacagcctgaaaaccgaggacacagccgtgtattactgttccacagatacgggtcctatagcagctcgtctcgcttactactactactacgctatggacgtctggggccaagggaccacggtcaccgtctcctca

SEQ ID NO: 29154 - protein, 130 aa, Artificial Sequence
  Description of Artificial Sequence: Synthetic polypeptide
EVQLVESGGGLVKPGGSLRLSCAASGFTFSNAWMNWVRLAPGKGLEWVGRIKSKTDGGTTDYAAPVKGRFTISRDDSENTLYLQMNSLKTEDTAVYYCSTDTGPIAARLAYYYYYAMDVWGQGTTVTVSS

SEQ ID NO: 29155 - DNA, 345 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcagtacctataacttgaactgggtccgccaggctccagggaaggggctggagtgggtctcatccattagtggtggtgccggtcacatatattactcagactcagtgaagggccgattcaccatctccagagacaacgccaagaactcactgtatctgcaaatgaacagcctgagagccgaggacacggctgtgtattactgtgcgaggactaatgggtttgacttctggggccagggaaccctggtcaccgtctcctca

SEQ ID NO: 29156 - protein, 115 aa, Artificial Sequence
  Description of Artificial Sequence: Synthetic polypeptide
EVQLVESGGGLVKPGGSLRLSCAASGFTFSTYNLNWVRQAPGKGLEWVSSISGGAGHIYYSDSVKGRFTISRDNAKNSLYLQMNSLRAEDTAVYYCARTNGFDFWGQGTLVTVSS

SEQ ID NO: 29157 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtactagtactttcatatactacgcagattcagtgaagggccgattcaccatctcaagagacaacgccaagaactcactgtatctgcaaatgaacagcctgagagccgaggacacggctgtgtattactgtgcgagaaaggctgggcttgatatctggggccaagggacaatggtcaccgtctcttca

SEQ ID NO: 29158 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISTSTFIYYADSVKGRFTISRDNAKNSLYLQMNSLRAEDTAVYYCARKAGLDIWGQGTMVTVSS

SEQ ID NO: 29159 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataacataaactgggtccgccaggctccagggaaggggctggagtgggtctcatccattagtggtaatagtggttacatatactacgcagactcagtgaagggccgattcaccatctccagagacaacgccaagaactcactgtatctgcaaatgaacagcctgagagccgaggacacggctgtgtattactgtgcgcgaactaacctctttgactactggggccagggaaccctggtcaccgtctcctca

SEQ ID NO: 29160 - protein, 115 aa, Artificial Sequence
  Description of Artificial Sequence: Synthetic polypeptide
EVQLVESGGGLVKPGGSLRLSCAASGFTFSSYNINWVRQAPGKGLEWVSSISGNSGYIYYADSVKGRFTISRDNAKNSLYLQMNSLRAEDTAVYYCARTNLFDYWGQGTLVTVSS

SEQ ID NO: 29161 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttattactggggctggatccgccagccccccgggaaggggctggactggattgggagtatctattatagtgggagcgccaactacaacccgtccctcaagagtcgagtcaccatatccgtagacacgtccaagaaccagttctccctgaaactgagttccgtgaccgccgcagacgcggctgtgtattactgtgcgagactggacaggggctggtcctttgactactggggccagggaaccctggtcaccgtctcctca

SEQ ID NO: 29162 - protein, 119 aa, Artificial Sequence
  Description of Artificial Sequence: Synthetic polypeptide
QLQLQESGPGLVKPSETLSLTCTVSGGSISRSSYYWGWIRQPPGKGLDWIGSIYYSGSANYNPSLKSRVTISVDTSKNQFSLKLSSVTAADAAVYYCARLDRGWSFDYWGQGTLVTVSS

SEQ ID NO: 29163 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttattagtgggcgtggtggtagcacatactacgcagactccgtgaagggccggttcaccatctccagagacaattccaagaacacgctgtatctgcaaatgaacagcctgagagccgaggacacggccgtatattactgtgcgaaaagggggatagtgggagctactgaggcttttgatatctggggccaagggacaatggtcaccgtctcttca

SEQ ID NO: 29164 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGRGGSTYYADSVKGRFTISRDNSKNTLYLQMNSLRAEDTAVYYCAKRGIVGATEAFDIWGQGTMVTVSS

SEQ ID NO: 29165 - DNA, 357 bp, Artificial Sequence
  Description of Artificial Sequence: Synthetic polynucleotide
cagctgcagctgcaggagtcgggcccaggactggtgcagccttcggagaccctgtccctcacctgcactgtctctggtgtctccatcagtaggactagttactactggggctggctccgccagcccccagggaaggggctggagtggattggcaatatttattatagtgggagcgcctacaacaacccgtccctcaagagtcgagtcaccatatccgttgacacgtccaagaaccagttctccctgaagctgagttctgtgaccgccgcagacacggctgtgtattactgtgggagacatggacaagactggggccttgactactggggccagggaaccctggtcaccgtctcctca

SEQ ID NO: 29166 - protein, 119 aa, Artificial Sequence
  Description of Artificial Sequence: Synthetic polypeptide
QLQLQESGPGLVQPSETLSLTCTVSGVSISRTSYYWGWLRQPPGKGLEWIGNIYYSGSAYNNPSLKSRVTISVDTSKNQFSLKLSSVTAADTAVYYCGRHGQDWGLDYWGQGTLVTVSS

SEQ ID NO: 29167 - DNA, 339 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgcgtctgggtaactactggggccagggaaccctggtcaccgtctcctca

SEQ ID NO: 29168 - protein, 113 aa, Artificial Sequence; identical to SEQ ID NO: 29150
  Description of Artificial Sequence: Synthetic polypeptide

SEQ ID NO: 29169 - DNA, 354 bp, Artificial Sequence
  Description of Artificial Sequence: Synthetic polynucleotide
caggtgcagctggtgcagtctgggactgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccttgaccaggaacacctccataagcacagcctacatggaactgagcagcctgagatctgaggacacggccgtgtattactgtgcgagtagcagtggctggtactactttgactactggggccagggaaccctggtcaccgtctcctca

SEQ ID NO: 29170 - protein, 118 aa, Artificial Sequence
  Description of Artificial Sequence: Synthetic polypeptide
QVQLVQSGTEVKKPGASVKVSCKASGYTFTNYDINWVRQATGQGLEWMGWMHPNSGNTGYAQKFQGRVTLTRNTSISTAYMELSSLRSEDTAVYYCASSSGWYYFDYWGQGTLVTVSS

SEQ ID NO: 29171 - DNA, 354 bp, Artificial Sequence
  Description of Artificial Sequence: Synthetic polynucleotide
caggtgcagctggtgcagtctgggactgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccttgaccagggacacctccataagcacagcctacatggaactgagcagcctgagatctgaggacacggccgtgtattactgtgcgagtagcagtggctggtactactttgactactggggccagggaaccctggtcaccgtgtcctca

SEQ ID NO: 29172 - protein, 118 aa, Artificial Sequence
  Description of Artificial Sequence: Synthetic polypeptide
QVQLVQSGTEVKKPGASVKVSCKASGYTFTNYDINWVRQATGQGLEWMGWMHPNSGNTGYAQKFQGRVTLTRDTSISTAYMELSSLRSEDTAVYYCASSSGWYYFDYWGQGTLVTVSS

SEQ ID NO: 29173 - DNA, 372 bp, Artificial Sequence
  Description of Artificial Sequence: Synthetic polynucleotide
caggtgaagctggtgcagtctggggctgaggtgaagaagcctggggcctcagtgaaggtctcctgcaaggcttcaggatacaccttcaccggctactatatgcactgggtgcgacaggcccctggacaagggcttgagtggatgggatggatcaaccctaacagtggtggcacaaactatgtacagaagtttcagggcagggtcaccatgaccagggacacgtccatcagcacagcctacatggagctgagcaggctgagatctgacgacacggccgtgtattactgtgcgagagtgtattactatggttcggggagttattataacgagtttgactactggggccagggaaccctggtcaccgtctcctca

SEQ ID NO: 29174 - protein, 124 aa, Artificial Sequence
  Description of Artificial Sequence: Synthetic polypeptide
QVKLVQSGAEVKKPGASVKVSCKASGYTFTGYYMHWVRQAPGQGLEWMGWINPNSGGTNYVQKFQGRVTMTRDTSISTAYMELSRLRSDDTAVYYCARVYYYGSGSYYNEFDYWGQGTLVTVSS

SEQ ID NO: 29175 - DNA, 372 bp, Artificial Sequence; identical to SEQ ID NO: 29173
  Description of Artificial Sequence: Synthetic polynucleotide

SEQ ID NO: 29176 - protein, 124 aa, Artificial Sequence; identical to SEQ ID NO: 29174
  Description of Artificial Sequence: Synthetic polypeptide

SEQ ID NO: 29177 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcctgagtggatgggatggatgcaccctaacagtggtaacacaggctatgcaaagaagttccagggcagagtcaccatgaccaggaacacctccataagcgcagcctatatggttctgagcagcctgagatctgaggacacggccgtgtattactgtgcgcttagcagtggctggtactactttgactactggggccagggaaccctggtcaccgtctcctca

SEQ ID NO: 29178 - protein, 118 aa, Artificial Sequence
  Description of Artificial Sequence: Synthetic polypeptide
QVQLVQSGAEVKKPGASVKVSCKASGYTFTNYDINWVRQATGQGPEWMGWMHPNSGNTGYAKKFQGRVTMTRNTSISAAYMVLSSLRSEDTAVYYCALSSGWYYFDYWGQGTLVTVSS

SEQ ID NO: 29179 - DNA, 354 bp, Artificial Sequence
  Description of Artificial Sequence: Synthetic polynucleotide
caggtgctcctggtgcagtctggggctgaggtgaagaggcctggggcctcagtgaaggtctcctgcaaggcttctggatacaccttcaccaattatgatattaattgggtgcgacaggccactggacaagggcttgagtggatgggatggatgtaccctaacagtggtaacacaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 29180 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMYPNSGNTGYAQKFQGRVTMTRDTSISTAYMELSSLRSEDTAVYYCASSSGWYYFDYWGQGTLVTVSS

SEQ ID NO: 29181 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgatggaagtaataaatactatgcagactccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 29182 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHDGSNKYYADSVKGRFTISRDNSKNTLYLQMSSLRAEDTAVYYCARDLSMGGMDVWGQGTTVTVSS

SEQ ID NO: 29183 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgcctaccatatgcactgggtgcgacaggcccctggacaaggacttgagtggatgggatggatcaaccctaacaataatggcacaaactatgcacagaagtttcagggcagggtcaccatgaccagggacacgtccatcagcacagcctacatggagctgagcaggctgagatctgacgacacggccgtttattactgtgggagagatgttaccagctcgtttgactattggggccagggaaccctggtcaccgtctcctca

SEQ ID NO: 29184 - protein, 117 aa, Artificial Sequence
  Description of Artificial Sequence: Synthetic polypeptide
QVQLVQSGAEVKKPGASVKVSCKASGYTFTAYHMHWVRQAPGQGLEWMGWINPNNNGTNYAQKFQGRVTMTRDTSISTAYMELSRLRSDDTAVYYCGRDVTSSFDYWGQGTLVTVSS

SEQ ID NO: 29185 - DNA, 351 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaccgactactatttgcactgggtgcgacaggcccctggacaaggtcttgagtggatgggatgggtccaccctaacagtggtggcacaaactttgcacagaagtttcaggacagggtcaccatgaccagggacacgtccatcagcacagcctacatggagctgagcagcctgagatctgacgacacggccatatattcctgtgcgcgagatggtaccagctcgtttgactactggggccagggaaccctggtcaccgtctcctca

SEQ ID NO: 29186 - protein, 117 aa, Artificial Sequence
  Description of Artificial Sequence: Synthetic polypeptide
QVQLVQSGAEVKKPGASVKVSCKASGYTFTDYYLHWVRQAPGQGLEWMGWVHPNSGGTNFAQKFQDRVTMTRDTSISTAYMELSSLRSDDTAIYSCARDGTSSFDYWGQGTLVTVSS

SEQ ID NO: 29187 - DNA, 354 bp, Artificial Sequence
  Description of Artificial Sequence: Synthetic polynucleotide
caggtgcagctgctgcagtctggggctgaggtgaagaagcctggggcctcagtgaaggtctcctgcaaggcttctggatacaccttcaccaattatgatatcaactgggtgcgacaggccactggacaagggcttgagtggatgggatggatgtaccctaacagtggtaacacgggctatgcacagaagttccagggcagagtcaccatgaccatgaacacctccataagcacagcctacatggagttgagcagcctgagatctgaggacacggccgtgtattactgtgcgatgagcagtggctggtactactttgacttctggggccagggaaccctggtcaccgtctcctca

SEQ ID NO: 29188 - protein, 118 aa, Artificial Sequence
  Description of Artificial Sequence: Synthetic polypeptide
QVQLLQSGAEVKKPGASVKVSCKASGYTFTNYDINWVRQATGQGLEWMGWMYPNSGNTGYAQKFQGRVTMTMNTSISTAYMELSSLRSEDTAVYYCAMSSGWYYFDFWGQGTLVTVSS

SEQ ID NO: 29189 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatatggtatgatggaagtaataagtactatgcagactccgtgaagggccgattcaccatctccagagacaattccaagaacacgctgtatctacaaatgaacagcctgagagccgtggacacggctgtgtattactgtgcgagagaggagtatagcagtggctggtacgactacggtatggacgtctggggccaagggaccacggtcaccgtctcctca

SEQ ID NO: 29190 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAVDTAVYYCAREEYSSGWYDYGMDVWGQGTTVTVSS

SEQ ID NO: 29191 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactgtgtcatgcactgggtccgccaggctccaggcaaggggctggagtgggtggcagttatatggtatgatggaagtaataaatactatgcagactccgtgaagggccgaatcaccatctccagagacaattccaagaacacgctgtatctgcaaatgaacagcctgagagccgaggacacggctgtgtattactgtgcgagagaggagtatagcagtggctggtacgactacggtatggacgtctggggccaagggaccacggtcaccgtctcctca

SEQ ID NO: 29192 - protein, 123 aa, Artificial Sequence
  Description of Artificial Sequence: Synthetic polypeptide
QVQLVESGGGVVQPGRSLRLSCAASGFTFSNCVMHWVRQAPGKGLEWVAVIWYDGSNKYYADSVKGRITISRDNSKNTLYLQMNSLRAEDTAVYYCAREEYSSGWYDYGMDVWGQGTTVTVSS

SEQ ID NO: 29193 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaacttcagtagctatggcatgcactgggtccgccaggctccaggcaaggggctggagtggatggcagttatatggtatgatggaagtaataaatactatgcagactccgtgaagggccgattcaccatctccagagacaattccaagaacacgctgtatctgcaaatgcacagcctgagagccgaggacacggctgtgtattactgtgcgagagatgagaggctggggatttttgactactggggccagggaaccctggtcaccgtctcctca

SEQ ID NO: 29194 - protein, 118 aa, Artificial Sequence
  Description of Artificial Sequence: Synthetic polypeptide
QVQLVESGGGVVQPGRSLRLSCAASGFNFSSYGMHWVRQAPGKGLEWMAVIWYDGSNKYYADSVKGRFTISRDNSKNTLYLQMHSLRAEDTAVYYCARDERLGIFDYWGQGTLVTVSS

SEQ ID NO: 29195 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggcaagggactggagtgggtgacagttatatggcatgatggaagtaatgcatactatgcagactccgtgaagggccgattcaccatctccagagacaattccaagaacacgctgtatctgcaaatgaacagcctgagagccgaggacacggctgtgtattactgtgcgagagaaaatagcagctcgtactactttgactactggggccagggaaccctggtcaccgtctcctca

SEQ ID NO: 29196 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVTVIWHDGSNAYYADSVKGRFTISRDNSKNTLYLQMNSLRAEDTAVYYCARENSSSYYFDYWGQGTLVTVSS

SEQ ID NO: 29197 - DNA, 354 bp, Artificial Sequence
  Description of Artificial Sequence: Synthetic polynucleotide
caggtgcagctggtgcagtctggggctgaggtgaggaagcctggggcctcagtgaaggtctcctgcaaggcttctggatacaccttcaccaattatgatatcaactgggtgcgacaggccactggacaagggcctgagtggatgggatggatgcaccctaacagtggtaacacaggctatgcaaagaagttccagggcagagtcaccatgaccaggaacacctccataagcgcagcctatatggttctgagcagcctgagatctgaggacacggccgtgtattactgtgcgcttagcagtggctggtactactttgactactggggccagggaaccctggtcaccgtctcctca

SEQ ID NO: 29198 - protein, 118 aa, Artificial Sequence
  Description of Artificial Sequence: Synthetic polypeptide
QVQLVQSGAEVRKPGASVKVSCKASGYTFTNYDINWVRQATGQGPEWMGWMHPNSGNTGYAKKFQGRVTMTRNTSISAAYMVLSSLRSEDTAVYYCALSSGWYYFDYWGQGTLVTVSS

SEQ ID NO: 29199 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctccgccattagtggtaatagtacttacatatactacgcagactcgttgaagggccgattcaccatctccagagacaacgccaagaactcactgtttctgcaactgaacagcctgagagccgaggacacggctgtttattactgtgcgagagatcggggcagtgaatggggccagggaaccctggtcaccgtctcctca

SEQ ID NO: 29200 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSAISGNSTYIYYADSLKGRFTISRDNAKNSLFLQLNSLRAEDTAVYYCARDRGSEWGQGTLVTVSS

SEQ ID NO: 29201 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtgttaacacattcgacgcagactccgtgaagggccggttcaccatctccagagacaattccaagaacacgctgtatctgcaaatgaacagcctgagagccgaggacacggccgtatattactgtgcgaaggaaaggagtgggagctattttgactactggggccagggaaccctggtcaccgtctcctca

SEQ ID NO: 29202 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGRGVNTFDADSVKGRFTISRDNSKNTLYLQMNSLRAEDTAVYYCAKERSGSYFDYWGQGTLVTVSS

SEQ ID NO: 29203 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatgaaaataataaatactatgcagactccgtgaagggccgattcaccatctccagagacaattccaagaacacgctgtatctgcaaatgaacagcctgagagccgaggacacggctgtgtattactgtgcgagagagctaggattttccaatgactactggggccagggaaccctggtcaccgtctcctca

SEQ ID NO: 29204 - protein, 117 aa, Artificial Sequence
  Description of Artificial Sequence: Synthetic polypeptide
QVQLVESGGGVVQPGRSLRLSCAASGFTFSSYGIHWVRQAPGKGLEWVAVIWYDENNKYYADSVKGRFTISRDNSKNTLYLQMNSLRAEDTAVYYCARELGFSNDYWGQGTLVTVSS

SEQ ID NO: 29205 - DNA, 345 bp, Artificial Sequence
  Description of Artificial Sequence: Synthetic polynucleotide
gaggtgcagctggtggagtctgggggaggcctggtcaagccgggggggtccctgagactctcctgtgcagcctctggattcaccttcagtagctataccatgaactgggtccgccaggttccagggaaggggctggagtgggtctcatccattagtggaagtagtacttacatatactacgcagactcagtgaagggccgattcaccatctccagagacgacgcccagaactcactgtatctgcaaatgaacagcctgagaggcgaggacacggctgtgtattactgtgcgagggtgacctcttttgactactggggccagggagccctggtcaccgtctcctca

SEQ ID NO: 29206 - protein, 115 aa, Artificial Sequence
  Description of Artificial Sequence: Synthetic polypeptide
EVQLVESGGGLVKPGGSLRLSCAASGFTFSSYTMNWVRQVPGKGLEWVSSISGSSTYIYYADSVKGRFTISRDDAQNSLYLQMNSLRGEDTAVYYCARVTSFDYWGQGALVTVSS

SEQ ID NO: 29207 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtattaacacattcgacgcagactccgtgaagggccggttcaccatctccagagacaattccaagaacacgctgtatctgcaaatgaacagcctgagagccgaggacacggccgtatattactgtgcgaaggaaaggagtgggagctattttgactactggggccagggaaccctggtcaccgtctcctca

SEQ ID NO: 29208 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGRGINTFDADSVKGRFTISRDNSKNTLYLQMNSLRAEDTAVYYCAKERSGSYFDYWGQGTLVTVSS

SEQ ID NO: 29209 - DNA, 339 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgatctggatccgccaggctccagggaaggggctggagtgggtttcatacattagtagtagtggtattaccaaatactacgcagactctatgaagggccgattcaccatctccagggacaacgccaagaactcactgtatctgcaaatgaacagcctgagagccgaggacacggccgtgtattactgtgcggccgatacaatctactggggccagggaaccctggtcaccgtctcctca

SEQ ID NO: 29210 - protein, 113 aa, Artificial Sequence
  Description of Artificial Sequence: Synthetic polypeptide
QVQLVESGGGLVKPGGSLRLSCAASGFTFSDYYMIWIRQAPGKGLEWVSYISSSGITKYYADSMKGRFTISRDNAKNSLYLQMNSLRAEDTAVYYCAADTIYWGQGTLVTVSS

SEQ ID NO: 29211 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgacatctgaggacacggccgtgtattactgtgcccatagcagtggctggaccctctttgactactggggccagggaaccctggtcaccgtctccgca

SEQ ID NO: 29212 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLTSEDTAVYYCAHSSGWTLFDYWGQGTLVTVSA

SEQ ID NO: 29213 - DNA, 354 bp, Artificial Sequence; identical to SEQ ID NO: 29207
  Description of Artificial Sequence: Synthetic polynucleotide

SEQ ID NO: 29214 - protein, 118 aa, Artificial Sequence; identical to SEQ ID NO: 29208
  Description of Artificial Sequence: Synthetic polypeptide

SEQ ID NO: 29215 - DNA, 339 bp, Artificial Sequence
  Description of Artificial Sequence: Synthetic polynucleotide
caggtgcagctggtggagtctgggggaggcttggtcaagcctggagggtccctgagactctcctgtgcagcctctggaatcaccttcagtgactactacatgaactggatccgccaggctccagggaaggggctggagtgggtttcatacattagtagtagtggtagaaccatattctacgcagactctttgaagggccgattcaccatctccagggacaacgccaagaactcactgtatctgcaaatgaacagcctgagagccgaggacacggccgtgtattactgtgcggccgatacaatctactggggccagggaaccctggtcaccgtctcctca

SEQ ID NO: 29216 - protein, 113 aa, Artificial Sequence
  Description of Artificial Sequence: Synthetic polypeptide
QVQLVESGGGLVKPGGSLRLSCAASGITFSDYYMNWIRQAPGKGLEWVSYISSSGRTIFYADSLKGRFTISRDNAKNSLYLQMNSLRAEDTAVYYCAADTIYWGQGTLVTVSS

SEQ ID NO: 29217 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagttgggtccgccaggctccagggatggggctggagtgggtctcagctattagtggtagtggtagtaacacattctacgcagactccgtgaagggccggttcaccatctccagagacaattccaagaacacgctgtatctgcacatgaacagcctgagagccgaggacactgccgtatatttctgtgcgaaacgaacgccctctgatgtttttgatatctggggccaagggacaatggtcaccgtctcttca

SEQ ID NO: 29218 - protein, 118 aa, Artificial Sequence
  Description of Artificial Sequence: Synthetic polypeptide
EVQLLESGGGLVQPGGSLRLSCAASGFTFSSYAMSWVRQAPGMGLEWVSAISGSGSNTFYADSVKGRFTISRDNSKNTLYLHMNSLRAEDTAVYFCAKRTPSDVFDIWGQGTMVTVSS

SEQ ID NO: 29219 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattctccttcagtgactatggcatgcactgggtccgccaggctccaggcaaggggctggagtgggtggcagttatatggtatgatggaagtaataaatactatgcagactccgtgaagggccgactcaccatctccagagacaattccaagaacacgctgtatctgcaaatgaacagcctgagagccgaggacacggctgtgtattactgtgcgaggcggtatgtcagaagctgggtgggaggtatggacgtctggggccaagggaccacggtcaccgtctcctca

SEQ ID NO: 29220 - protein, 121 aa, Artificial Sequence
  Description of Artificial Sequence: Synthetic polypeptide
QVQLVESGGGVVQPGRSLRLSCAASGFSFSDYGMHWVRQAPGKGLEWVAVIWYDGSNKYYADSVKGRLTISRDNSKNTLYLQMNSLRAEDTAVYYCARRYVRSWVGGMDVWGQGTTVTVSS

SEQ ID NO: 29221 - DNA, 369 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtgactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtatagcagtggctggtacgactacggtatggacgtctggggccaagggaccacggtcaccgtctcctca

SEQ ID NO: 29222 - protein, 123 aa, Artificial Sequence
  Description of Artificial Sequence: Synthetic polypeptide
QVQLVESGGGVVQPGRSLRLSCTASGFTFSDYGMHWVRQAPGKGLEWVAVIWYDGSNKYYADSVKGRFTISRDNSKNTLYLQMNSLRAEDTAVYYCARERYSSGWYDYGMDVWGQGTTVTVSS

SEQ ID NO: 29223 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtttgaaggaagtaataaatactatgcagattccgtgaagggccgattcaccatctccagagacaattccaagaacacgctgtatctgcaaatgagcagcctgagagccgaggacacggctgtgtattactgtgtgagagaactaggattttccaccgactactggggccagggaaccctggtcaccgtctcctca

SEQ ID NO: 29224 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWFEGSNKYYADSVKGRFTISRDNSKNTLYLQMSSLRAEDTAVYYCVRELGFSTDYWGQGTLVTVSS

SEQ ID NO: 29225 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgctgactccgtgaagggccgattcaccatctccagagacaattccaagaacacgctgtatctgcaaatgaacagcctgagagccgaggacacggctgtgtattactgtgcgagagaaaggtatagcagtggcttgtacgactacggtatggacgtctggggccaagggaccacggtcaccgtctcctca

SEQ ID NO: 29226 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCARERYSSGLYDYGMDVWGQGTTVTVSS

SEQ ID NO: 29227 - DNA, 354 bp, Artificial Sequence
  Description of Artificial Sequence: Synthetic polynucleotide
gaggtgcacctgttggagtctgggggaggcttggtacagcctggggggtccctgagactctcctgtgcagcctctggattcacctttagcagctatgccatgagctgggtccgccaggctccagggaaggggctggagtgggtctcaattctcagtggtggtggtaagaccacatactacgcagactccgtgaagggccggttcaccatctccagagacaattccaagaacacgctgtttctgcaaatgaacagcctgagagccgaggacacggccgtatattactgtgcgaaacgaacgccctctgatgcttttgatatctggggccaagggacaatggtcaccgtctcttca

SEQ ID NO: 29228 - protein, 118 aa, Artificial Sequence
  Description of Artificial Sequence: Synthetic polypeptide
EVHLLESGGGLVQPGGSLRLSCAASGFTFSSYAMSWVRQAPGKGLEWVSILSGGGKTTYYADSVKGRFTISRDNSKNTLFLQMNSLRAEDTAVYYCAKRTPSDAFDIWGQGTMVTVSS

SEQ ID NO: 29229 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagtcccgtatagcagcagctggtacgactacggtatggacgtctggggccaagggaccacggtcaccgtctcctca

SEQ ID NO: 29230 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCARVPYSSSWYDYGMDVWGQGTTVTVSS

SEQ ID NO: 29231 - DNA, 345 bp, Artificial Sequence
  Description of Artificial Sequence: Synthetic polynucleotide
caggtgcacctgcaggagtcgggcccaggactggtgaagccttcggagaccctgtccctcacctgcactgtctctggtggctccatcagtagttactactggagctggatccggcagcccccagggaagggactggagtggattgggtatatctattacagtggaaacaccaactacaacccctccctcaagagtcgagtcaccatatcagtagacacgtccaagaaccagttctccctgaagctgagctctgtgaccgctgcggacacggccgtgtattactgtgtgagaggggtggctataaagaactactggggccagggaatcctggtcaccgtctcctca

SEQ ID NO: 29232 - protein, 115 aa, Artificial Sequence
  Description of Artificial Sequence: Synthetic polypeptide
QVHLQESGPGLVKPSETLSLTCTVSGGSISSYYWSWIRQPPGKGLEWIGYIYYSGNTNYNPSLKSRVTISVDTSKNQFSLKLSSVTAADTAVYYCVRGVAIKNYWGQGILVTVSS

SEQ ID NO: 29233 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaataactatggcatgcactgggtccgccaggctccaggcaaggggctggagtgggtggcagttatatggtatgaaggaagtaataaatactatgcagactccgtgaagggccgattcaccatctccagagacaattccaagaacacgctgtatctgcaaatgaacagcctgagagccgaggacacggctgtgtattactgtgtgagagaactggggttcctctctgactactggggccagggaaccctggtcaccgtctcctca

SEQ ID NO: 29234 - protein, 117 aa, Artificial Sequence
  Description of Artificial Sequence: Synthetic polypeptide
QVQLVESGGGVVQPGRSLRLSCAASGFTFNNYGMHWVRQAPGKGLEWVAVIWYEGSNKYYADSVKGRFTISRDNSKNTLYLQMNSLRAEDTAVYYCVRELGFLSDYWGQGTLVTVSS

SEQ ID NO: 29235 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaccatatagcagcagctggtacgactacggtatggacgtcgggggccaagggaccacggtcaccgtctcctca

SEQ ID NO: 29236 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCAREPYSSSWYDYGMDVGGQGTTVTVSS

SEQ ID NO: 29237 - DNA, 363 bp, Artificial Sequence
  Description of Artificial Sequence: Synthetic polynucleotide
caggtgcagttggtggagtctgggggaggcgtggtccagcctgggaggtccctgagactctcctgtgtagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattattgtgcgaggcggtatagcagcagctgggtggggggtatggacgtctggggccaagggaccacggtcaccgtctcctca

SEQ ID NO: 29238 - protein, 121 aa, Artificial Sequence
  Description of Artificial Sequence: Synthetic polypeptide
QVQLVESGGGVVQPGRSLRLSCVASGFTFSSYGMHWVRQAPGKGLEWVAVIWYDGSNKYYADSVKGRFTISRDNSKNTLYLQMNSLRAEDTAVYYCARRYSSSWVGGMDVWGQGTTVTVSS

SEQ ID NO: 29239 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactgtgtcatgcactgggtccgccaggctccaggcaaggggctggagtgggtggcagttatatggtatgatggaagtaataaatactatgctgactccgtgaagggccgattcaccatctccagagacaattccaagaacacgctgtatctgcaaatgaacagcctgagagccgaggacacggctgtgtattactgtgcgagagaaaggtatagcagtggcttgtacgactacggtatggacgtctggggccaagggaccacggtcaccgtctcctca

SEQ ID NO: 29240 - protein, 123 aa, Artificial Sequence
  Description of Artificial Sequence: Synthetic polypeptide
QVQLVESGGGVVQPGRSLRLSCAASGFTFSDCVMHWVRQAPGKGLEWVAVIWYDGSNKYYADSVKGRFTISRDNSKNTLYLQMNSLRAEDTAVYYCARERYSSGLYDYGMDVWGQGTTVTVSS

SEQ ID NO: 29241 - DNA, 354 bp, Artificial Sequence; identical to SEQ ID NO: 29201
  Description of Artificial Sequence: Synthetic polynucleotide

SEQ ID NO: 29242 - protein, 118 aa, Artificial Sequence; identical to SEQ ID NO: 29202
  Description of Artificial Sequence: Synthetic polypeptide

SEQ ID NO: 29243 - DNA, 363 bp, Artificial Sequence
  Description of Artificial Sequence: Synthetic polynucleotide
gaggtgcagctgttggagtctgggggaggcttggtacagtctggagggtccctgagactctcctgtgcagcctctggattcacctttagcagctatgccatgaactgggtccgccaggctccagggaaggggctggagtgggtctcaggtgttgttggtagtggtggtagaacatactacgcagactccgtgaagggccggttcatcatctccagagacaattccaagaacacgctgtatctgcaaatgaacagcctgagagccgaggacacggccgtatattactgtgcgaaagatcgggggcagtggctcctaggcggtatggacgtctggggccaagggaccacggtcaccgtctcctca

SEQ ID NO: 29244 - protein, 121 aa, Artificial Sequence
  Description of Artificial Sequence: Synthetic polypeptide
EVQLLESGGGLVQSGGSLRLSCAASGFTFSSYAMNWVRQAPGKGLEWVSGVVGSGGRTYYADSVKGRFIISRDNSKNTLYLQMNSLRAEDTAVYYCAKDRGQWLLGGMDVWGQGTTVTVSS

SEQ ID NO: 29245 - DNA, 372 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctatagcgtgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagaagtggatacagctatgcttactactactactacggtatggacgtctggggccaagggaccacggtcaccgtctcctca

SEQ ID NO: 29246 - protein, 124 aa, Artificial Sequence
  Description of Artificial Sequence: Synthetic polypeptide
EVQLVESGGGLVQPGGSLRLSCAASGFTFSSYSVNWVRQAPGKGLEWVSYISSSSSTIYYADSVKGRFTISRDNAKNSLYLQMNSLRDEDTAVYYCARSGYSYAYYYYYGMDVWGQGTTVTVSS

SEQ ID NO: 29247 - DNA, 360 bp, Artificial Sequence
  Description of Artificial Sequence: Synthetic polynucleotide
caggtgcacctggcggagtctgggggaggcgtggtccagcctgggaggtccctgagactctcctgtgaagcgtctggattcaccctcagtagcgatgacacgcactgggtccgccagcctccaggcaaggggctggagtgggtggcagttatatggtttgatgaatataataaatactatgcagactccgtgaagggccgattcaccatctccagagacaattccaagaacacgctgtatctgcaaatgaacagcctgagagccgaggacgcggctgtgtattactgtgcgagagatctaatagcagcagctgggacgggagactactggggccagggaaccctggtcaccgtctcctca

SEQ ID NO: 29248 - protein, 120 aa, Artificial Sequence
  Description of Artificial Sequence: Synthetic polypeptide
QVHLAESGGGVVQPGRSLRLSCEASGFTLSSDDTHWVRQPPGKGLEWVAVIWFDEYNKYYADSVKGRFTISRDNSKNTLYLQMNSLRAEDAAVYYCARDLIAAAGTGDYWGQGTLVTVSS

SEQ ID NO: 29249 - DNA, 339 bp, Artificial Sequence
  Description of Artificial Sequence: Synthetic polynucleotide
caggtgcagctggtggagtctgggggaggcttggtcaagcctggagggtccctgagactctcctgtgcagcctctggattcacctttagtgactactacatgaactggatccgccaggctccagggaaggggctggagtgggtttcatacattagtagtagtggtattaccaaatactacgcagactctgtgaagggccgattcaccatctccagggacaacgccaagaactcactgtatctgcaaatgaacagcctgagagccgaggacacggccgtgtattactgtgcggccgatacaatctactggggccagggaaccctggtcaccgtctcctca

SEQ ID NO: 29250 - protein, 113 aa, Artificial Sequence
  Description of Artificial Sequence: Synthetic polypeptide
QVQLVESGGGLVKPGGSLRLSCAASGFTFSDYYMNWIRQAPGKGLEWVSYISSSGITKYYADSVKGRFTISRDNAKNSLYLQMNSLRAEDTAVYYCAADTIYWGQGTLVTVSS

SEQ ID NO: 29251 - DNA, 369 bp, Artificial Sequence; identical to SEQ ID NO: 29239
  Description of Artificial Sequence: Synthetic polynucleotide

SEQ ID NO: 29252 - protein, 123 aa, Artificial Sequence; identical to SEQ ID NO: 29240
  Description of Artificial Sequence: Synthetic polypeptide

SEQ ID NO: 29253 - DNA, 354 bp, Artificial Sequence; identical to SEQ ID NO: 29217
  Description of Artificial Sequence: Synthetic polynucleotide

SEQ ID NO: 29254 - protein, 118 aa, Artificial Sequence; identical to SEQ ID NO: 29218
  Description of Artificial Sequence: Synthetic polypeptide

SEQ ID NO: 29255 - DNA, 369 bp, Artificial Sequence; identical to SEQ ID NO: 29239
  Description of Artificial Sequence: Synthetic polynucleotide

SEQ ID NO: 29256 - protein, 123 aa, Artificial Sequence; identical to SEQ ID NO: 29240
  Description of Artificial Sequence: Synthetic polypeptide

SEQ ID NO: 29257 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtgttaacacattcgacgcagactccgtgaagggccggttcaccatatccagagacaattccaagaacacgctgtatctgcaaatgaacagcctgagagccgaggacacggccgtatattactgtgcgaaggaaaggagtgggagctattttgactactggggccagggaaccctggtcaccgtctcctca

SEQ ID NO: 29258 - protein, 118 aa, Artificial Sequence; identical to SEQ ID NO: 29202
  Description of Artificial Sequence: Synthetic polypeptide

SEQ ID NO: 29259 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttaacagctatgccatgagctgggtccgccaggctccagggaaggggctggagtgggtctcagttattagtggtcgtggtggtaccacatactacgcagactccgtgaagggccggttcaccatctccagagacaattccaagaacacgctgtatctgcaaatgaacagcctgagagccgaggacacggccgtatattactgtgcgaaacgaacgccctctgatgcttttgatatctggggccaagggacaatggtcaccgtctcttca

SEQ ID NO: 29260 - protein, 118 aa, Artificial Sequence
  Description of Artificial Sequence: Synthetic polypeptide
EVQLLESGGGLVQPGGSLRLSCAASGFTFNSYAMSWVRQAPGKGLEWVSVISGRGGTTYYADSVKGRFTISRDNSKNTLYLQMNSLRAEDTAVYYCAKRTPSDAFDIWGQGTMVTVSS

SEQ ID NO: 29261 - DNA, 345 bp, Artificial Sequence; identical to SEQ ID NO: 29205
  Description of Artificial Sequence: Synthetic polynucleotide

SEQ ID NO: 29262 - protein, 115 aa, Artificial Sequence; identical to SEQ ID NO: 29206
  Description of Artificial Sequence: Synthetic polypeptide

SEQ ID NO: 29263 - DNA, 360 bp, Artificial Sequence
  Description of Artificial Sequence: Synthetic polynucleotide
caggtgcacctggcggagtctgggggaggcgtggtccagcctgggaggtccctgagactctcctgtgaagcgtctggattcaccctcagtagcgatgactcgcactgggtccgccagcctccaggcaaggggctggagtgggtggcagttatatggtttgatgaatatactaaatactatgcagactccgtgaagggccgattcaccatctccagagacaattccaagaacacgctgtatctgcaaatgaacaacctgagagccgaggacgcggctgtgtattactgtgcgagagatctaatagcagcaactgggacgggagactactggggccagggaaccctggtcaccgtctcctca

SEQ ID NO: 29264 - protein, 120 aa, Artificial Sequence
  Description of Artificial Sequence: Synthetic polypeptide
QVHLAESGGGVVQPGRSLRLSCEASGFTLSSDDSHWVRQPPGKGLEWVAVIWFDEYTKYYADSVKGRFTISRDNSKNTLYLQMNNLRAEDAAVYYCARDLIAATGTGDYWGQGTLVTVSS

SEQ ID NO: 29265 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagtaataaatactatgtagactccgtgaagggccgattcaccatctccagagacaattccaagaacacgctgtatctgcaaatgaacagcctgagagccgaggacacggctgtgtattactgtgcgagagatcgatacgatttttggagtggttactttgactactggggccagggaaccctggtcaccgtctcctca

SEQ ID NO: 29266 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSNKYYVDSVKGRFTISRDNSKNTLYLQMNSLRAEDTAVYYCARDRYDFWSGYFDYWGQGTLVTVSS

SEQ ID NO: 29267 - DNA, 369 bp, Artificial Sequence; identical to SEQ ID NO: 29225
  Description of Artificial Sequence: Synthetic polynucleotide

SEQ ID NO: 29268 - protein, 123 aa, Artificial Sequence; identical to SEQ ID NO: 29226
  Description of Artificial Sequence: Synthetic polypeptide

SEQ ID NO: 29269 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgattatggcatgcactgggtccgccaggctccaggcaaggggctggagtgggtggcagttatatggtttgaaggaagtaataaatactatgcagattccgtgaagggccgattcaccatctccagagacaattccaagaacacgctgtatgtgcaaatgaacagcctgagagccgaggacacggctgtgtattactgtgtgagagaactaggattttccaatgactactggggccagggaaccctggtcaccgtctcctca

SEQ ID NO: 29270 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFEGSNKYYADSVKGRFTISRDNSKNTLYVQMNSLRAEDTAVYYCVRELGFSNDYWGQGTLVTVSS

SEQ ID NO: 29271 - DNA, 369 bp, Artificial Sequence
  Description of Artificial Sequence: Synthetic polynucleotide
caggtgcagctggtggagtctgggggaggcgtagtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagtcccgtatagcagcagttggtacgactacggtatggacgtctggggccaagggaccacggtcaccgtctcctca

SEQ ID NO: 29272 - protein, 123 aa, Artificial Sequence; identical to SEQ ID NO: 29230
  Description of Artificial Sequence: Synthetic polypeptide

SEQ ID NO: 29273 - DNA, 354 bp, Artificial Sequence; identical to SEQ ID NO: 29207
  Description of Artificial Sequence: Synthetic polynucleotide

SEQ ID NO: 29274 - protein, 118 aa, Artificial Sequence; identical to SEQ ID NO: 29208
  Description of Artificial Sequence: Synthetic polypeptide

SEQ ID NO: 29275 - DNA, 351 bp, Artificial Sequence; identical to SEQ ID NO: 29203
  Description of Artificial Sequence: Synthetic polynucleotide

SEQ ID NO: 29276 - protein, 117 aa, Artificial Sequence; identical to SEQ ID NO: 29204
  Description of Artificial Sequence: Synthetic polypeptide

SEQ ID NO: 29277 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgattatggcatacactgggtccgccaggctccaggcaaggggctggagtgggtggcagttatatggtttgaaggaagtaataaatactatgcagattccgtgaagggccgattcaccatctccagagacaattccaagaacacgctgtatgtgcaaatgaacagcctgagagccgaggacacggctgtgtattactgtgtgagagaactaggattttccaatgactactggggccagggaaccctggtcaccgtctcctca

SEQ ID NO: 29278 - protein, 117 aa, Artificial Sequence
  Description of Artificial Sequence: Synthetic polypeptide
QVQLVESGGGVVQPGRSLRLSCAASGFTFSDYGIHWVRQAPGKGLEWVAVIWFEGSNKYYADSVKGRFTISRDNSKNTLYVQMNSLRAEDTAVYYCVRELGFSNDYWGQGTLVTVSS

SEQ ID NO: 29279 - DNA, 363 bp, Artificial Sequence
  Description of Artificial Sequence: Synthetic polynucleotide
caggtgcagctggtggagtctgggggaggcgtggtccagcctgggaggtccctgagactctcctgttcagcgtctggattcaccttcagtagctatggcatgcactgggtccgccaggctccaggcaaggggctggagtgggtggcagttatatggtatgatggaagaaataaatactatgcagactccgtgaagggccgaatcaccatctccagagacaattccaagaacacgctgtatctgcaaatgaacagcctgagagccgaggacacggctgtgtattactgtgcgaggcggtatagcagcagctggatgggaggtatggacgtctggggccaagggaccacggtcaccgtctcctca

SEQ ID NO: 29280 - protein, 121 aa, Artificial Sequence
  Description of Artificial Sequence: Synthetic polypeptide
QVQLVESGGGVVQPGRSLRLSCSASGFTFSSYGMHWVRQAPGKGLEWVAVIWYDGRNKYYADSVKGRITISRDNSKNTLYLQMNSLRAEDTAVYYCARRYSSSWMGGMDVWGQGTTVTVSS

SEQ ID NO: 29281 - DNA, 339 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgaactggatccgccaggctccagggaaggggctggagtgggtttcatacattaatagtaatggttttaccatatactacgcagactctgtgaagggccgattcaccatctccagggacaacgccaagaactcactgtatctgcaaatgaacagcctgagagccgaggacacggccgtgtattactgtgcggccgatacaatctactggggccagggaaccctggtcaccgtctcctca

SEQ ID NO: 29282 - protein, 113 aa, Artificial Sequence
  Description of Artificial Sequence: Synthetic polypeptide
QVQLVESGGGLVKPGGSLRLSCAASGFTFSDYYMNWIRQAPGKGLEWVSYINSNGFTIYYADSVKGRFTISRDNAKNSLYLQMNSLRAEDTAVYYCAADTIYWGQGTLVTVSS

SEQ ID NO: 29283 - DNA, 351 bp, Artificial Sequence
  Description of Artificial Sequence: Synthetic polynucleotide
caggtgcagctggtggagtcggggggaggcgtggtccagcctgggaggtccctgagactctcctgtgcagcgtctggattcaccttcagtgactatggcatgcactgggtccgccaagctccaggcaaggggctggagtgggtggcagttatatggtatgatgactataataaaaagtatgcagactccgtgaagggccgattcaccatctccagagacaatgccaagaacacgctgtatctgcaagtgaacagcctgagagtcgaagacacggctgtgtattactgtgcgacagaactggggatgctctttgactactggggccagggaaccctggtcaccgtctcctca

SEQ ID NO: 29284 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDDYNKKYADSVKGRFTISRDNAKNTLYLQVNSLRVEDTAVYYCATELGMLFDYWGQGTLVTVSS

SEQ ID NO: 29285 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccagactccaggcaaggggctggagtgggtggcagttatatggtatgatggaagtaataaatactatgcagactccgtgaagggccgattcaccatctccagagacaattccaagaacacgctgtttctgcaaatgaacagcctgagagacgaggacacggctgtgtattactgtgcgagacggtatagccgcagctgggtgggaggtatggacgtctggggccaagggaccacggtcaccgtctcctca

SEQ ID NO: 29286 - protein, 121 aa, Artificial Sequence
  Description of Artificial Sequence: Synthetic polypeptide
QVQLVESGGGVVQPGRSLRLSCAASGFTFSDYGMHWVRQTPGKGLEWVAVIWYDGSNKYYADSVKGRFTISRDNSKNTLFLQMNSLRDEDTAVYYCARRYSRSWVGGMDVWGQGTTVTVSS

SEQ ID NO: 29287 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgacgatgacacacactgggtccgccaggctccaggcaaggggctggagtgggtggcagttatatggtttgatggaagtaataaatactatgcagactccgtgaagggccgattcaccatctccagagacaattccaagaacacgctgtatctgcaaatgaacagcctgagcgccgaggacacggctgtgtattactgtgcgagagatcttatagcagcagctggtacagttgactactggggccagggaaccctggtcaccgtctcctca

SEQ ID NO: 29288 - protein, 120 aa, Artificial Sequence
  Description of Artificial Sequence: Synthetic polypeptide
QVQLVESGGGVVQPGRSLRLSCAASGFTFSDDDTHWVRQAPGKGLEWVAVIWFDGSNKYYADSVKGRFTISRDNSKNTLYLQMNSLSAEDTAVYYCARDLIAAAGTVDYWGQGTLVTVSS

SEQ ID NO: 29289 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagtaactatgccatgagctgggtccgccaggctccagggaaggggctggagtgggtctcaggtattagtggtagtggtagtcgcacatactacgcagactccgtgaagggccggttcaccatctccagagacaattccaagaacacgctgtatctgcaaatgaacagcctgagagccgaggacacggccgtatattactgtgcgaaagatcgggggcagtggctcataggcggtatggacgtctggggccaagggaccacggtcaccgtctcctca

SEQ ID NO: 29290 - protein, 121 aa, Artificial Sequence
  Description of Artificial Sequence: Synthetic polypeptide
EVQLLESGGGLVQPGGSLRLSCAASGFTFSNYAMSWVRQAPGKGLEWVSGISGSGSRTYYADSVKGRFTISRDNSKNTLYLQMNSLRAEDTAVYYCAKDRGQWLIGGMDVWGQGTTVTVSS

SEQ ID NO: 29291 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtatctatggcatgcactgggtccgccaggctccaggcaaggggctggagtgggtggcagttatatggtatgatggaagtaataaatactatgcagactccgtgaagggccgattcaccatctccagagacaattccaagaacacgctgtatcttcaaatgaacagcctgagagccgaggacacggctgtgtattactgtgcgagacggtatagcagaagctgggtgggaggtatggacgtctggggccaagggaccacggtcaccgtctcctca

SEQ ID NO: 29292 - protein, 121 aa, Artificial Sequence
  Description of Artificial Sequence: Synthetic polypeptide
QVQLVESGGGVVQPGRSLRLSCAASGFTFSIYGMHWVRQAPGKGLEWVAVIWYDGSNKYYADSVKGRFTISRDNSKNTLYLQMNSLRAEDTAVYYCARRYSRSWVGGMDVWGQGTTVTVSS

SEQ ID NO: 29293 - DNA, 357 bp, Artificial Sequence
  Description of Artificial Sequence: Synthetic polynucleotide
gaggtgcagttgttggactctgggggaggcttggtgcagcctggggggtccctgagactctcctgtgcagcctctggattcacctttagcagctatgccatgagttgggtccgccaggctccagggaaggggctggagtgggtctcagctattagtggtcgtggtggtaacacattctacgcagagtccgtgaggggccggttcaccatctccagagacaattccaagaacacgctgtatctgcaaatgaacagcctgagagccgaggacacggccgtatattactgtgcgaagattatccgggagcagtgggcctttgactactggggccagggaaccctggtcaccgtctcctca

SEQ ID NO: 29294 - protein, 119 aa, Artificial Sequence
  Description of Artificial Sequence: Synthetic polypeptide
EVQLLDSGGGLVQPGGSLRLSCAASGFTFSSYAMSWVRQAPGKGLEWVSAISGRGGNTFYAESVRGRFTISRDNSKNTLYLQMNSLRAEDTAVYYCAKIIREQWAFDYWGQGTLVTVSS

SEQ ID NO: 29295 - DNA, 339 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgatctggatccgccaggctccagggaaggggctggagtgggtttcatacattaatagtaatggttttaccaaatactacgcagactctgtgaagggccgattcaccatctccagggacaacgccaagaattcactgtatctgcaaatgaacagtctgagagccgaggacacggccgtgtattactgtgcggccgatacagtctactggggccagggaaccctggtcaccgtctcctca

SEQ ID NO: 29296 - protein, 113 aa, Artificial Sequence
  Description of Artificial Sequence: Synthetic polypeptide
QVQLVESGGGLVKPGGSLRLSCAASGFTFSDYYMIWIRQAPGKGLEWVSYINSNGFTKYYADSVKGRFTISRDNAKNSLYLQMNSLRAEDTAVYYCAADTVYWGQGTLVTVSS

SEQ ID NO: 29297 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttgtatggtatgatgaaattaataaaaagtatgcagactccgtgaagggccgagtcaccatctccagagacaattccaagaacacgctgtatctgcaaatgaacagcctgagagccgaggacacggctatgtattactgtgcgagagaattagggtgggaggctgactactggggccagggaaccctggtcaccgtctcctca

SEQ ID NO: 29298 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVVWYDEINKKYADSVKGRVTISRDNSKNTLYLQMNSLRAEDTAMYYCARELGWEADYWGQGTLVTVSS

SEQ ID NO: 29299 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctagattcacctttagcagttatgccatgagctgggtccgccaggctccagggaaggggctggagtgggtctcagttattagtggtcgtggtggtagcacattctacgcagactccgtgaagggccggttcaccatctccagagacaattccaagaacacgctgtatctgcaaatgaacagcctgagagccgaggacacggccgtatattactgtgcgcgtcgtatagcagtggctgggaatgaggcttttgatatctggggccaagggacaatggtcaccgtctcttca

SEQ ID NO: 29300 - protein, 121 aa, Artificial Sequence
  Description of Artificial Sequence: Synthetic polypeptide
EVQLLESGGGLVQPGGSLRLSCAASRFTFSSYAMSWVRQAPGKGLEWVSVISGRGGSTFYADSVKGRFTISRDNSKNTLYLQMNSLRAEDTAVYYCARRIAVAGNEAFDIWGQGTMVTVSS

SEQ ID NO: 29301 - DNA, 369 bp, Artificial Sequence
  Description of Artificial Sequence: Synthetic polynucleotide
caggtgcagctggtggagtctgggggaggcgtggtccagcctgggaggtctctgagactctcctgtgcagcgtctggattcaccttcagtaactatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtatagcagcagctggtacgactacggtctggacgtctggggccaagggaccacggtcaccgtctcctca

SEQ ID NO: 29302 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCARERYSSSWYDYGLDVWGQGTTVTVSS

SEQ ID NO: 29303 - DNA, 363 bp, Artificial Sequence; identical to SEQ ID NO: 29299
  Description of Artificial Sequence: Synthetic polynucleotide

SEQ ID NO: 29304 - protein, 121 aa, Artificial Sequence; identical to SEQ ID NO: 29300
  Description of Artificial Sequence: Synthetic polypeptide

SEQ ID NO: 29305 - DNA, 354 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagaaactctgccatgaactgggtccgccaggctccagggaaggggctggagtgggtctcagctattagtggtagtggtggtaccacattctacgcagactccgtgaagggccggttcaccatctccagagacaattccaagaacacgttgtatctgcaaataaacagcctgagagccgaggacacggccgtatattactgtgcgaaatgtgggcgggagcagtggcttgactactggggccagggaaccctggtcaccgtctcctca

SEQ ID NO: 29306 - protein, 118 aa, Artificial Sequence
  Description of Artificial Sequence: Synthetic polypeptide
EVQLLESGGGLVQPGGSLRLSCAASGFTFRNSAMNWVRQAPGKGLEWVSAISGSGGTTFYADSVKGRFTISRDNSKNTLYLQINSLRAEDTAVYYCAKCGREQWLDYWGQGTLVTVSS

SEQ ID NO: 29307 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggccccaggcaaggggctggagtgggtggcagttatatggtatgaggaaaataagaaatactatgcagactccgtgaagggccgattcaccatctccagagacaattccaagaacacgctgtttctgcaaatgaatagcctgagagccgaggacacggctatgtatttctgtgcgagagaacttgcctggtacgaggactactggggccagggaaccctggtcaccgtctcctca

SEQ ID NO: 29308 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYEENKKYYADSVKGRFTISRDNSKNTLFLQMNSLRAEDTAMYFCARELAWYEDYWGQGTLVTVSS

SEQ ID NO: 29309 - DNA, 357 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactacttcatgacctggatccgccaggctccagggcaggggctggagtgggtttcatacattagtagtgctggtggtgccatatactacgcagactctgtgaagggccgattcaccatctccagggacaacgccaaaaactcactgtatctgcaaatgaacagcctgagagccgaggacacggccgtgtattactgtgcaatagcagtggctgcccctggtgtttttgatatctggggccaagggacaatggtcaccgtctcttca

SEQ ID NO: 29310 - protein, 119 aa, Artificial Sequence
  Description of Artificial Sequence: Synthetic polypeptide
QVQLVESGGGLVKPGGSLRLSCAASGFTFSDYFMTWIRQAPGQGLEWVSYISSAGGAIYYADSVKGRFTISRDNAKNSLYLQMNSLRAEDTAVYYCAIAVAAPGVFDIWGQGTMVTVSS

SEQ ID NO: 29311 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaggggcctggagtgggtggcagttatatggtatgatgtaagtaataaatactatgtagactccgtgaagggccgattcaccatctccagagacaattccaagaacacgctgtatctgcaaatgaacagcctgagagccgaggacacggctgtgtattactgtgcgagagaactggggatgagatctgactactggggccagggaaccctggtcaccgtctcctca

SEQ ID NO: 29312 - protein, 117 aa, Artificial Sequence
  Description of Artificial Sequence: Synthetic polypeptide
QVQLVESGGGVVQPGRSLRLSCAASGFTFSDYGMHWVRQAPGRGLEWVAVIWYDVSNKYYVDSVKGRFTISRDNSKNTLYLQMNSLRAEDTAVYYCARELGMRSDYWGQGTLVTVSS

SEQ ID NO: 29313 - DNA, 357 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactacttcatgacctggatccgccaggctccagggcaggggctggagtgggtttcatacattagtagtgctggtggtgccatatactacgcagactctgtgaagggccgattcaccatctccagggacaacgccaagaactcactgtttctgcaaatgaacagcctgagagccgaggacacggccgtgtattactgtgctatagcagtggctgcccctggtgcttttgatatctggggccaagggacattggtcaccgtctcttca

SEQ ID NO: 29314 - protein, 119 aa, Artificial Sequence
  Description of Artificial Sequence: Synthetic polypeptide
QVQLVESGGGLVKPGGSLRLSCAASGFTFSDYFMTWIRQAPGQGLEWVSYISSAGGAIYYADSVKGRFTISRDNAKNSLFLQMNSLRAEDTAVYYCAIAVAAPGAFDIWGQGTLVTVSS

SEQ ID NO: 29315 - DNA, 357 bp, Artificial Sequence; identical to SEQ ID NO: 29313
  Description of Artificial Sequence: Synthetic polynucleotide

SEQ ID NO: 29316 - protein, 119 aa, Artificial Sequence; identical to SEQ ID NO: 29314
  Description of Artificial Sequence: Synthetic polypeptide

SEQ ID NO: 29317 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaagataataaatattatgtagactccgtgaagggccgattcaccatctccagagacaattccaagaacacgctgtatctgcaaatgaacagcctgagagccgaggacacggctgtgtattactgtgcgagagaactggggttcctctctgactactggggccagggaaccctggtcaccgtctcctca

SEQ ID NO: 29318 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDEDNKYYVDSVKGRFTISRDNSKNTLYLQMNSLRAEDTAVYYCARELGFLSDYWGQGTLVTVSS

SEQ ID NO: 29319 - DNA, 363 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagcagctggtcgggcggtatggacgtctggggccaagggaccacggtcaccgtctcctca

SEQ ID NO: 29320 - protein, 121 aa, Artificial Sequence
  Description of Artificial Sequence: Synthetic polypeptide
QVQLVESGGGVVQPGRSLRLSCTASGFTFSSYGMHWVRQAPGKGLEWVAVIWYDGSNKYYADSVKGRFTISRDNSKNTLYLQMNSLRAEDTAVYYCARRYSSSWSGGMDVWGQGTTVTVSS

SEQ ID NO: 29321 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggactgggtctcagttattagtggtagtggtggtagcacattctacgcagactccgtgaagggccggttcaccatctccagagacaattccaagagcacgctgtatctgcaaatgaacagcctgagagccgaggacacggccgtatattattgtgcgagcgctatagcagcggctggtgcccactattttgactactggggccagggaaccctggtcaccgtctcctca

SEQ ID NO: 29322 - protein, 121 aa, Artificial Sequence
  Description of Artificial Sequence: Synthetic polypeptide
EVQLLESGGGLVQPGGSLRLSCAASGFTFSSYAMSWVRQAPGKGLDWVSVISGSGGSTFYADSVKGRFTISRDNSKSTLYLQMNSLRAEDTAVYYCASAIAAAGAHYFDYWGQGTLVTVSS

SEQ ID NO: 29323 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagcagctggtcgggcggaatggacgtctggggccaagggaccacggtcaccgtctcctca

SEQ ID NO: 29324 - protein, 121 aa, Artificial Sequence; identical to SEQ ID NO: 28488
  Description of Artificial Sequence: Synthetic polypeptide

SEQ ID NO: 29325 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgacctgggtccgccagactccagggaaggggctggagtgggtctcagctattagtggtagtggtggtaactcattctacgcagactccgtgaagggccggttcaccatctccagagacaattccgagaacacgttgtatctgcaaatgaacagcctgagagccgaggacacggccgtatattactgtgcgaaagcaagggcagtggctgggtcacactggttcgacccctggggccagggaaccctggtcaccgtctcctca

SEQ ID NO: 29326 - protein, 121 aa, Artificial Sequence
  Description of Artificial Sequence: Synthetic polypeptide
EVQLLESGGGLVQPGGSLRLSCAASGFTFSSYAMTWVRQTPGKGLEWVSAISGSGGNSFYADSVKGRFTISRDNSENTLYLQMNSLRAEDTAVYYCAKARAVAGSHWFDPWGQGTLVTVSS

SEQ ID NO: 29327 - DNA, 351 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtttgatgtaagtaataaaaagtatgtagactccgtgaagggccgattcaccatctccagagacaattccaagaacacgctgtatctgcaaatgagcagcctgagagccgaggacacggctgtgtattattgtgcgagagatctggggatgatcgaggactactggggccagggaaccctggtcaccgtctcctca

SEQ ID NO: 29328 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWFDVSNKKYVDSVKGRFTISRDNSKNTLYLQMSSLRAEDTAVYYCARDLGMIEDYWGQGTLVTVSS

SEQ ID NO: 29329 - DNA, 363 bp, Artificial Sequence; identical to SEQ ID NO: 28145
  Description of Artificial Sequence: Synthetic polynucleotide

SEQ ID NO: 29330 - protein, 121 aa, Artificial Sequence; identical to SEQ ID NO: 28146
  Description of Artificial Sequence: Synthetic polypeptide

SEQ ID NO: 29331 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcacttatatggtatgatggaaggaataaatactatgcagactccgtgaagggccgattcaccatctccagagacaatcccaagaacacgctgtatctgcaaatgaacagcctgagagccgaggacacggctgtgtatcactgtgcgagaaggtatagcagcagctggtcgggcggtatggacgtctggggccaagggaccacggtcaccgtctcctca

SEQ ID NO: 29332 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVALIWYDGRNKYYADSVKGRFTISRDNPKNTLYLQMNSLRAEDTAVYHCARRYSSSWSGGMDVWGQGTTVTVSS

SEQ ID NO: 29333 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcactgggtgcgacaggcccctggacaagggcttgagtggatgggatggatcaaccctaataacaatgccacaaactatgctcagaactttcagggcagggtcaccctgaccagggacacgtccatcagcacagcctacatggagctgagcaggctgagatctgacgacacggccgtgtattactgtgcgagagacggtaccagcagctttgacttctggggccagggaaccctggtcaccgtctcctca

SEQ ID NO: 29334 - protein, 117 aa, Artificial Sequence
  Description of Artificial Sequence: Synthetic polypeptide
QVQLVQSGAEVKKPGASVKVSCKASGYTFTGYHMHWVRQAPGQGLEWMGWINPNNNATNYAQNFQGRVTLTRDTSISTAYMELSRLRSDDTAVYYCARDGTSSFDFWGQGTLVTVSS

SEQ ID NO: 29335 - DNA, 363 bp, Artificial Sequence
  Description of Artificial Sequence: Synthetic polynucleotide
gaggtgcagctgttggagtctgggggaggcttggtacagcctggggggtccctgagactctcctgtacagcctctggattcacctttagcagctatgccatgagctgggtccgccaggctccagggaaggggctggagtgggtctcagttattagtggtagtggtggtaccacattctacgcagactccgtgaagggccggctcaccatctccagagacaattccaagaacacactgtatctgcaaatgaacagcctgagagccgaggacacggccgtatattactgtgcgcgtcgtatagcagtggctgggaatgatgcttttgatatctggggccaagggacaatggtcaccgtctcttca

SEQ ID NO: 29336 - protein, 121 aa, Artificial Sequence
  Description of Artificial Sequence: Synthetic polypeptide
EVQLLESGGGLVQPGGSLRLSCTASGFTFSSYAMSWVRQAPGKGLEWVSVISGSGGTTFYADSVKGRLTISRDNSKNTLYLQMNSLRAEDTAVYYCARRIAVAGNDAFDIWGQGTMVTVSS

SEQ ID NO: 29337 - DNA, 339 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgaactggatccgccaggctccagggaaggggctggagtgggtttcatacattaatagtaatggttttaccatatactacgcagactctgtgaagggccgattcaccatctccagggacaacgccaagaactcactgtatctgcaaatgaacagcctgagagccgaggacacggccgtgtattactgtgcggccgatacaatctactggggccagggaacccgggtcaccgtctcctca

SEQ ID NO: 29338 - protein, 113 aa, Artificial Sequence
  Description of Artificial Sequence: Synthetic polypeptide
QVQLVESGGGLVKPGGSLRLSCAASGFTFSDYYMNWIRQAPGKGLEWVSYINSNGFTIYYADSVKGRFTISRDNAKNSLYLQMNSLRAEDTAVYYCAADTIYWGQGTRVTVSS

SEQ ID NO: 29339 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctagattcacctttagcagttatgccatgagctgggtccgccaggctccagggaaggggctggagtgggtctcagttattagtggtcgtggtggtaccacattctacgcagactccgtgaagggccggttcaccatctccagagacaattccaagaacacgctgtatctgcaaatgaacagcctgagagccgaggacacggccgtatattactgtgcgcgtcgtatagcagtggctgggaatgaggcttttgatatctggggccaagggacaatggtcaccgtctcttca

SEQ ID NO: 29340 - protein, 121 aa, Artificial Sequence
  Description of Artificial Sequence: Synthetic polypeptide
EVQLLESGGGLVQPGGSLRLSCAASRFTFSSYAMSWVRQAPGKGLEWVSVISGRGGTTFYADSVKGRFTISRDNSKNTLYLQMNSLRAEDTAVYYCARRIAVAGNEAFDIWGQGTMVTVSS

SEQ ID NO: 29341 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctcctgggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtattactgtgcgagagtagcaacttttgactactggggccagggaaccctggtcaccgtctcctca

SEQ ID NO: 29342 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARVATFDYWGQGTLVTVSS

SEQ ID NO: 29343 - DNA, 363 bp, Artificial Sequence
  Description of Artificial Sequence: Synthetic polynucleotide
gaggggcagttgttggagtctgggggaggcttggtacagcctggggggtccctgagactctcctgtgcagcctctagattcacctttagcagttatgccatgagctgggtccgccaggctccagggaaggggctggagtgggtctcagttattagtggtcgtggtggtagcacattctacgcagactccgtgaagggccggttcaccatctccagagacaattccaagaacacgctgtatctgcaaatgaacagcctgagagccgaggacacggccgtatattactgtgcgcgtcgtatagcagtggctgggaatgaggcttttgatatctggggccaagggacaatggtcaccgtctcttca

SEQ ID NO: 29344 - protein, 121 aa, Artificial Sequence
  Description of Artificial Sequence: Synthetic polypeptide
EGQLLESGGGLVQPGGSLRLSCAASRFTFSSYAMSWVRQAPGKGLEWVSVISGRGGSTFYADSVKGRFTISRDNSKNTLYLQMNSLRAEDTAVYYCARRIAVAGNEAFDIWGQGTMVTVSS

SEQ ID NO: 29345 - DNA, 375 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggccactatataaactgggtgcgacaggcccctggacaagggcctgagtggatggcatgggtcaaccctaacagtggtggcacaaactctgcacagaagtttcagggcagggtcaccatgaccagggacacgtccatcagcacagtctacatggagctgagcaggctgagatctgacgacacggccgtgtattactgtgcgaggggagggcagctcggcgggtttaactactactactacggtatggacgtctggggccaagggaccacggtcaccgtctcctca

SEQ ID NO: 29346 - protein, 125 aa, Artificial Sequence
  Description of Artificial Sequence: Synthetic polypeptide
QVQLVQSGAEVKKPGASVKVSCKASGYTFTGHYINWVRQAPGQGPEWMAWVNPNSGGTNSAQKFQGRVTMTRDTSISTVYMELSRLRSDDTAVYYCARGGQLGGFNYYYYGMDVWGQGTTVTVSS

SEQ ID NO: 29347 - DNA, 378 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagccatagcatgaactgggtccgccaggctccagggaaggggctggagtgggtctcatccatcagtagtagtagtaattacatatactacgcagactcagtgaagggccgattcaccatctccagagactacgccaagaactcactttatctgcaaatgaacagcctgagagccgaggacacggctgtgtattactgtgcgagagatcggagcatagtagtggctggtccctgggactactacggtatggacgtctggggccaagggaccacggtcaccgtctcctca

SEQ ID NO: 29348 - protein, 126 aa, Artificial Sequence
  Description of Artificial Sequence: Synthetic polypeptide
EVQLVESGGGLVKPGGSLRLSCAASGFTFSSHSMNWVRQAPGKGLEWVSSISSSSNYIYYADSVKGRFTISRDYAKNSLYLQMNSLRAEDTAVYYCARDRSIVVAGPWDYYGMDVWGQGTTVTVSS

SEQ ID NO: 29349 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtagtaaatactatgcagactccgtgaagggccgattcaccatctccagagacaattccaagaacacgctgtatctgcaaatgaacagcctgagagccgaggacacggctgtgtattactgtgcgagaaggtatagcagcagttggtcgggcggtatggacgtctggggccaagggaccacggtcaccgtctcctca

SEQ ID NO: 29350 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSSKYYADSVKGRFTISRDNSKNTLYLQMNSLRAEDTAVYYCARRYSSSWSGGMDVWGQGTTVTVSS

SEQ ID NO: 29351 - DNA, 360 bp, Artificial Sequence
  Description of Artificial Sequence: Synthetic polynucleotide
gaggtgcagctgttggagtctgggggaggcttggtacagcctggggggtccctgagtctctcctgtgcagcctctggattcacctttagaagctatgtcatgagctgggtccgccaggctccagggaaggggctggagtgggtctcagctattagtggtcgtggtagtaacacattctacacagactccgtgaagggccggttcaccatctccagagacaattccaagaacacgctgtatctgcaaatgaacagcctgagagccgaggacacggccgtatattactgtgcgaaagggataactggatcacacggtgcttttgatatctggggccaagggacaatggtcaccgtctcttca

SEQ ID NO: 29352 - protein, 120 aa, Artificial Sequence
  Description of Artificial Sequence: Synthetic polypeptide
EVQLLESGGGLVQPGGSLSLSCAASGFTFRSYVMSWVRQAPGKGLEWVSAISGRGSNTFYTDSVKGRFTISRDNSKNTLYLQMNSLRAEDTAVYYCAKGITGSHGAFDIWGQGTMVTVSS

SEQ ID NO: 29353 - DNA, 351 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctatggcatgcactgggtccgccaggctccaggcaaggggctggagtgggtggcagttatatggtatgatgaaagtaataaatactatgcagactccgtgaagggccgattcaccatctccagagacaattccaagaacacgctgtatctgcaaatgaacagcctgagagccgaggacacggctgtgtattactgtgcgagggaactgggatttctctctgactactggggccagggaaccctggtcaccgtctcctca

SEQ ID NO: 29354 - protein, 117 aa, Artificial Sequence; identical to SEQ ID NO: 29004
  Description of Artificial Sequence: Synthetic polypeptide

SEQ ID NO: 29355 - DNA, 345 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttagcagctatgtcatgagctgggtccgccagactccagggaaggggctggagtgggtctcaactatgagtggtagtggtggtcgcacatactacgcagactccgtgaacggccgattcaccgtctccagagacaattccaagaacacgctgtatttgcaaatgagcagcctgagagccgaggacacggccgtatattactgtgcgcgggtgactgcttttgactactggggccagggaaccctggtcaccgtctcctca

SEQ ID NO: 29356 - protein, 115 aa, Artificial Sequence
  Description of Artificial Sequence: Synthetic polypeptide
EVQLLESGGGLVQPGGSLRLSCAASGFTFSSYVMSWVRQTPGKGLEWVSTMSGSGGRTYYADSVNGRFTVSRDNSKNTLYLQMSSLRAEDTAVYYCARVTAFDYWGQGTLVTVSS

SEQ ID NO: 29357 - DNA, 363 bp, Artificial Sequence
  Description of Artificial Sequence: Synthetic polynucleotide
gaggtgcagctgttggagtctgggggaggcttggtgcagcctggggggtccctgagactctcctgtgcagcctctggattcaccattagcaactatgccatgacctgggtccgccagactccagggaaggggctggagtgggtctcagttattagtgctagtggtggtaactcattctacgcagactccgtgaagggccggttcaccatctccagagacaattccgagaacacgttctatctgcaaatgaacagcctgagagccgaggacacggccgtatattactgtgcgaaagcaagggcagtggctgggtcacactggttcgacccctggggccagggaaccctggtcaccgtctcctca

SEQ ID NO: 29358 - protein, 121 aa, Artificial Sequence
  Description of Artificial Sequence: Synthetic polypeptide
EVQLLESGGGLVQPGGSLRLSCAASGFTISNYAMTWVRQTPGKGLEWVSVISASGGNSFYADSVKGRFTISRDNSENTFYLQMNSLRAEDTAVYYCAKARAVAGSHWFDPWGQGTLVTVSS

SEQ ID NO: 29359 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagctcgccttgactactggggccagggaaccctggtcaccgtctcctca

SEQ ID NO: 29360 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARARLDYWGQGTLVTVSS

SEQ ID NO: 29361 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcactgggtgcgacaggcccctggacaagggcttgagtggatgggatggatcaaccctaataataatgccacaaactatgctcagagctttcagggcagggtcaccctgaccagggacacgtccatcagcacagcctacatggagctgagcaggctgagatctgacgacacggccgtgtattactgtgcgagagacggtaccagcagctttgacttctggggccagggaaccctggtcaccgtctcctca

SEQ ID NO: 29362 - protein, 117 aa, Artificial Sequence
  Description of Artificial Sequence: Synthetic polypeptide
QVQLVQSGAEVKKPGASVKVSCKASGYTFTGYHMHWVRQAPGQGLEWMGWINPNNNATNYAQSFQGRVTLTRDTSISTAYMELSRLRSDDTAVYYCARDGTSSFDFWGQGTLVTVSS

SEQ ID NO: 29363 - DNA, 375 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggccactatatgaactgggtgcgacaggcccctggacaaggacttgagtggatgggatgggtcaaccctaacagtggtggctcaaactctgcacagcagtttcagggcagggtcaccatgaccagggacacgtccatcagcacagtctacatggagctgagcaggctgagttctgacgacacggccgtgtattactgtgcgaggggagggcagctcggcggctttaacttctactactacggtatggacgtctggggccaagggaccacggtcaccgtctcctca

SEQ ID NO: 29364 - protein, 125 aa, Artificial Sequence
  Description of Artificial Sequence: Synthetic polypeptide
QVQLVQSGAEVKKPGASVKVSCKASGYTFTGHYMNWVRQAPGQGLEWMGWVNPNSGGSNSAQQFQGRVTMTRDTSISTVYMELSRLSSDDTAVYYCARGGQLGGFNFYYYGMDVWGQGTTVTVSS

SEQ ID NO: 29365 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctagatacaccttcaccggctaccatatacactgggtgcgacaggcccctggacaagggcttgagtggatgggatggatcaaccctaacactaatggcacacagtatgcacagaagtttcagggccgggtcaccatgaccagggacacgtccatcagcacagcctacatggagctgagcaggctgagatctgacgacacggccgtgtattactgtgcgagagatggcacctcgtcctttgactactggggccagggaaccctggtcaccgtctcctca

SEQ ID NO: 29366 - protein, 117 aa, Artificial Sequence
  Description of Artificial Sequence: Synthetic polypeptide
QVQLVQSGAEVKKPGASVKVSCKASRYTFTGYHIHWVRQAPGQGLEWMGWINPNTNGTQYAQKFQGRVTMTRDTSISTAYMELSRLRSDDTAVYYCARDGTSSFDYWGQGTLVTVSS

SEQ ID NO: 29367 - DNA, 351 bp, Artificial Sequence
  Description of Artificial Sequence: Synthetic polynucleotide
caggtgcagctggtggagtctgggggaggcgtggtccagccggggaggtccctgagactctcctgtgcagcgtctggattcaccttcagtgactatggcatgcactgggtccgccaggctccaggcaaggggctggagtgggtggcagttatatggtttgatggaaataataaatactatgcagactccgtgaagggccgattcaccatctccagagacaattccaagaacacgctgtatctgcaaatgaacagcctgagcgccgaggacacggctgtgtattactgtgcgagggagctgggatttctctctgactactggggccagggaaccctggtcaccgtctcctca

SEQ ID NO: 29368 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFDGNNKYYADSVKGRFTISRDNSKNTLYLQMNSLSAEDTAVYYCARELGFLSDYWGQGTLVTVSS

SEQ ID NO: 29369 - DNA, 363 bp, Artificial Sequence; identical to SEQ ID NO: 29335
  Description of Artificial Sequence: Synthetic polynucleotide

SEQ ID NO: 29370 - protein, 121 aa, Artificial Sequence; identical to SEQ ID NO: 29336
  Description of Artificial Sequence: Synthetic polypeptide

SEQ ID NO: 29371 - DNA, 351 bp, Artificial Sequence
  Description of Artificial Sequence: Synthetic polynucleotide
caggtgcagctggtggagtctgggggaggcgtggtccagccggggaggtccctgagactctcctgtgcagcgtctggattcaccttcagtgactatggcatgcactgggtccgccaggctccaggcaaggggctggagtgggtggcagttatatggtttggtggaaataataaatactatggagactccgtgaagggccgattcaccatctccagagacaattccaagaacacgctgtatctgcaaatgaacagcctgagcgccgaggacacggctgtgtattactgtgcgagggagctgggatttctctctgactactggggccagggaaccctggtcaccgtctcctca

SEQ ID NO: 29372 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFGGNNKYYGDSVKGRFTISRDNSKNTLYLQMNSLSAEDTAVYYCARELGFLSDYWGQGTLVTVSS

SEQ ID NO: 29373 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactttggcatgcactgggtccgccaggctccaggcaaggggctggagtgggtggcagttatatggtatgaggaaagtaataaatactatgcagactccgtgaagggccgattcaccatctccagagacaattccaagaacacgctgtatctgcaaatgaacagcctgagagccgaggacacggctgtgtattactgtgcgagagaactggggttcctctctgacttctggggccagggaaccctggtcaccgtctcctca

SEQ ID NO: 29374 - protein, 117 aa, Artificial Sequence
  Description of Artificial Sequence: Synthetic polypeptide
QVQLVESGGGVVQPGRSLRLSCAASGFTFSNFGMHWVRQAPGKGLEWVAVIWYEESNKYYADSVKGRFTISRDNSKNTLYLQMNSLRAEDTAVYYCARELGFLSDFWGQGTLVTVSS

SEQ ID NO: 29375 - DNA, 351 bp, Artificial Sequence
  Description of Artificial Sequence: Synthetic polynucleotide
caggtgcagttggtgcagtctggggctgaggtgaagaagcctggggcctcagtgaaggtctcctgcaaggcttctggatacaccttcaccggctatcatatgcagtgggtgcgacaggcccctggacaagggcttgagtggatgggatggatcaaccctaacagtggtgccacaaactatgcacagaactttcagggcagggtcaccatgacccgggacacgtccatcagcacagcctacctggacctgagcaggctgagatctgacgacacggccgtgtattactgtgcgagagatggcacctcgtcctttgactactggggccagggaaccctggtcaccgtctcctca

SEQ ID NO: 29376 - protein, 117 aa, Artificial Sequence
  Description of Artificial Sequence: Synthetic polypeptide
QVQLVQSGAEVKKPGASVKVSCKASGYTFTGYHMQWVRQAPGQGLEWMGWINPNSGATNYAQNFQGRVTMTRDTSISTAYLDLSRLRSDDTAVYYCARDGTSSFDYWGQGTLVTVSS

SEQ ID NO: 29377 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttacatggtttgatggaagtaatcaacgctatgcagactccgtgaagggccgattcaccatctccagagacatttccaagaacacgctgtatctgcaaatgaacagcctgagtgccgaggacacggctgtgtattactgtgcgagagatctggggatgatcgaggacttctggggccagggaaccctggtcaccgtctcctca

SEQ ID NO: 29378 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVTWFDGSNQRYADSVKGRFTISRDISKNTLYLQMNSLSAEDTAVYYCARDLGMIEDFWGQGTLVTVSS

SEQ ID NO: 29379 - DNA, 354 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagcagaaatgccatgagctgggtccgccaggctccagggatggggctggagtgggtctcagctattagtggtcgtggtggtaatacattctacgcagactccgtgaagggccggttcaccgtctccagagacaattccaagaacacgctgtttctgcaaatgaacagcctgagagccgaggacacggccgtatattactgtgcgaaaaatgggcgagagcagtggcttgactactggggccagggaaccctggtcaccgtctcctca

SEQ ID NO: 29380 - protein, 118 aa, Artificial Sequence
  Description of Artificial Sequence: Synthetic polypeptide
EVQLLESGGGLVQPGGSLRLSCAASGFTFSRNAMSWVRQAPGMGLEWVSAISGRGGNTFYADSVKGRFTVSRDNSKNTLFLQMNSLRAEDTAVYYCAKNGREQWLDYWGQGTLVTVSS

SEQ ID NO: 29381 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataaaatgaactgggtccgccaggctccagggaaggggctggagtgggtctcatccattagtagtggtaatagttccatatactacgcagactcagtgaagggccgattcaccatctccagagacaacgccgaaaactcactgtatctgcaaatgaacagcctgagagccgaagacacggctgtgtattactgtgcgagagttagcagtaatgactactggggccagggaaccctggtcaccgtctcctca

SEQ ID NO: 29382 - protein, 115 aa, Artificial Sequence
  Description of Artificial Sequence: Synthetic polypeptide
EVQLVESGGGLVKPGGSLRLSCAASGFTFSSYKMNWVRQAPGKGLEWVSSISSGNSSIYYADSVKGRFTISRDNAENSLYLQMNSLRAEDTAVYYCARVSSNDYWGQGTLVTVSS

SEQ ID NO: 29383 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcaattatatcatatggaggaagtaataaatactatgcagactccgtgaagggccgattcaccatctccagagacaattccaagaatacgctgtatctgcaaatgaacagcctgagagctgatgacacggctgtgtattactgtgcgagaaggtcagcagctcggccgggctacggtatggacgtctggggccaggggaccacggtcaccgtctcctca

SEQ ID NO: 29384 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIISYGGSNKYYADSVKGRFTISRDNSKNTLYLQMNSLRADDTAVYYCARRSAARPGYGMDVWGQGTTVTVSS

SEQ ID NO: 29385 - DNA, 351 bp, Artificial Sequence; identical to SEQ ID NO: 29367
  Description of Artificial Sequence: Synthetic polynucleotide

SEQ ID NO: 29386 - protein, 117 aa, Artificial Sequence; identical to SEQ ID NO: 29368
  Description of Artificial Sequence: Synthetic polypeptide

SEQ ID NO: 29387 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcacttatatggtatgatggaagtaataaataccatgcagactccgtgaagggccgattcaccatctccagagacaattccaagaacacgctgtatctgcaaatgaacagcctgagagccgaggacacggctgtgtattactgtgcgagaaggtatagcagcagctggtcgggcggtatggacgtctggggccaagggaccacggtcaccgtctcctca

SEQ ID NO: 29388 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVALIWYDGSNKYHADSVKGRFTISRDNSKNTLYLQMNSLRAEDTAVYYCARRYSSSWSGGMDVWGQGTTVTVSS

SEQ ID NO: 29389 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtttctatggcatgcactgggtccgccaggctccaggcaaggggctggagtgggtggcagttatatgggacgatggaagtaataaatactatgcagactccgtgaagggccgattcaccatctccagagacaattccaagaacacgctgtttctgcaaatgatgagcctgagagccgaggacacggctgtgtattactgtgcgagagattctctgtatagcagcagctggttgtttgactactggggccagggaaccctggtcaccgtctcctca

SEQ ID NO: 29390 - protein, 121 aa, Artificial Sequence
  Description of Artificial Sequence: Synthetic polypeptide
QVQLVESGGGVVQPGRSLRLSCAASGFTFSFYGMHWVRQAPGKGLEWVAVIWDDGSNKYYADSVKGRFTISRDNSKNTLFLQMMSLRAEDTAVYYCARDSLYSSSWLFDYWGQGTLVTVSS

SEQ ID NO: 29391 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcagtgggtgcgacaggcccctggacaagggcttgagtggatgggatggatcaaccctaacaatggtggcacacagtatgcacagaagtttcagggccgggtcaccatgaccagggacacgtccatcagcacagcctacatggaactgagcaggctgagatctgacgacacggccgtgtattactgtgcgagagatggcacctcgtcctttgactactggggccagggaaccctggtcaccgtctcctcg

SEQ ID NO: 29392 - protein, 117 aa, Artificial Sequence
  Description of Artificial Sequence: Synthetic polypeptide
QVQLVQSGAEVKKPGASVKVSCKASGYTFTGYHMQWVRQAPGQGLEWMGWINPNNGGTQYAQKFQGRVTMTRDTSISTAYMELSRLRSDDTAVYYCARDGTSSFDYWGQGTLVTVSS

SEQ ID NO: 29393 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgattcaccgtctccagagacaacgccaagaactcactgtatctgcaagtgaacagcctgagagccgaggacacggctgtgtattactgtgcgagagtcaactcctttgactactggggccagggaaccctggtcaccgtctcctca

SEQ ID NO: 29394 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYIYYADSVKGRFTVSRDNAKNSLYLQVNSLRAEDTAVYYCARVNSFDYWGQGTLVTVSS

SEQ ID NO: 29395 - DNA, 342 bp, Artificial Sequence
  Description of Artificial Sequence: Synthetic polynucleotide
gaggtgcagctggtggagtctgggggaggcctggtcaagcctggggagtccctgagactctcctgtgcagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtattactgtgcgagagatcggggcagcacctggggccagggaaccctggtcaccgtctcctca

SEQ ID NO: 29396 - protein, 114 aa, Artificial Sequence
  Description of Artificial Sequence: Synthetic polypeptide
EVQLVESGGGLVKPGESLRLSCAASGFTFSSYSMNWVRQAPGKGLEWVSSISGSSSYIYYADSVKGRFTISRDNAKNSLYLQMNSLRAEDTAVYYCARDRGSTWGQGTLVTVSS

SEQ ID NO: 29397 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggaatgggtgacagttgtatgggatgatggaagtaataaatactatgcagactccgtgaagggccgattcaccatctccagagacaattccaagaacacgctgtatctgcaaatgaacagcctgagagccgaggacacggctgtgtattactgtacgaggggccttggctttacgggagactactggggccagggagccctggtcaccgtctcctca

SEQ ID NO: 29398 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVTVVWDDGSNKYYADSVKGRFTISRDNSKNTLYLQMNSLRAEDTAVYYCTRGLGFTGDYWGQGALVTVSS

SEQ ID NO: 29399 - DNA, 360 bp, Artificial Sequence
  Description of Artificial Sequence: Synthetic polynucleotide
gaggtgcagttgttggagtctgggggaggcttgatacagcctggggggtccctgagactctcctgtgcagcctctggattcacctttaggagctatgccatgagctgggtccgccaggctccagggaaggggctggagtgggtctcagctattagtggtagtggtggtaacacattctacgcagactccgtgaagggccggttcaccatctccagagacaattccaagaacacgctgtatttgcaaatgaacaccctgagagccgacgacacggccgtatattactgtgcgaaaaaggtcgtggatacagccatggctcttgactactggggccagggaaccctggtcaccgtctcctca

SEQ ID NO: 29400 - protein, 120 aa, Artificial Sequence
  Description of Artificial Sequence: Synthetic polypeptide
EVQLLESGGGLIQPGGSLRLSCAASGFTFRSYAMSWVRQAPGKGLEWVSAISGSGGNTFYADSVKGRFTISRDNSKNTLYLQMNTLRADDTAVYYCAKKVVDTAMALDYWGQGTLVTVSS

SEQ ID NO: 29401 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggccggagtgggtggcagttatatcatatggtggaagtaataaataccatgcagactccgtgaagggccgattcaccatctccagagacaattccaagaacacgctgtatctgcaaatgaacagcctgagagctgaggacacggctgtgtattactgtgcgaggcggggagcagctcgtcctggctacggtatggacgtctggggccaagggaccacggtcaccgtctcctca

SEQ ID NO: 29402 - protein, 121 aa, Artificial Sequence
  Description of Artificial Sequence: Synthetic polypeptide
QVQLVESGGGVVQPGRSLRLSCAASGFTFSSYGMHWVRQAPGKGPEWVAVISYGGSNKYHADSVKGRFTISRDNSKNTLYLQMNSLRAEDTAVYYCARRGAARPGYGMDVWGQGTTVTVSS

SEQ ID NO: 29403 - DNA, 345 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgtcatgagctgggtccgccaggctccagggaaggggctggagtgggtctcaggtattagtggtagtggtggtcgcacatactacgcagactccgtgaagggccggttcaacatctccagagacaattccaagaacacgctgtatctgcaaatgaacagcctgagagccgaggacacggccgtctattactgtgcgagggtggccctttttgactactggggccagggaaccctggtcaccgtctcctca

SEQ ID NO: 29404 - protein, 115 aa, Artificial Sequence
  Description of Artificial Sequence: Synthetic polypeptide
EVQLLESGGGLVQPGGSLRLSCAASGFTFSSYVMSWVRQAPGKGLEWVSGISGSGGRTYYADSVKGRFNISRDNSKNTLYLQMNSLRAEDTAVYYCARVALFDYWGQGTLVTVSS

SEQ ID NO: 29405 - DNA, 360 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagctattagtggtagtggtggtgccacatactacgcagactccgtgaagggccggttcaccatctccagagacaattccaagaacacgctgtatctgcaaatgaacagcctgagagccgaggacacggccgtatattattgtgcgaaacctctagtgggagcccatgatgcttttgaaatctggggccaagggacaatggtcaccgtctcttca

SEQ ID NO: 29406 - protein, 120 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGATYYADSVKGRFTISRDNSKNTLYLQMNSLRAEDTAVYYCAKPLVGAHDAFEIWGQGTMVTVSS

SEQ ID NO: 29407 - DNA, 351 bp, Artificial Sequence
  Description of Artificial Sequence: Synthetic polynucleotide
caggtccagctggtggagtctgggggaggcgtggtccagcctgggaggtccctgagactctcctgtacaacgtctggattcaccttcagtgactatggcatccactgggtccgccaggctccaggcaaggggctggagtgggtggcagttatatggtatgatgaaagtaataaatactatggagactccgtgaagggccgattcgccatctccagagacaattccaagaacacgctgtatctgcaaatgaacagcctgagagccgaggacacggctgtgtattattgtgtgagagaactggggatgacgtctgactactggggccagggaaccctggtcaccgtctcctca

SEQ ID NO: 29408 - protein, 117 aa, Artificial Sequence
  Description of Artificial Sequence: Synthetic polypeptide
QVQLVESGGGVVQPGRSLRLSCTTSGFTFSDYGIHWVRQAPGKGLEWVAVIWYDESNKYYGDSVKGRFAISRDNSKNTLYLQMNSLRAEDTAVYYCVRELGMTSDYWGQGTLVTVSS

SEQ ID NO: 29409 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatggtggaagtaataaatacgatgcagactccgtgaagggccgattcaccatctccagagacaattccaagaacacgctgtatctgcaaatgaccagcctgagagctgaggacacggctgtgtattactgtgcgagacgacgggcagctcgtccagggtacggtatggacgtctggggccaagggaccacggtcaccgtctcctca

SEQ ID NO: 29410 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYGGSNKYDADSVKGRFTISRDNSKNTLYLQMTSLRAEDTAVYYCARRRAARPGYGMDVWGQGTTVTVSS

SEQ ID NO: 29411 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcactgggtgcgacaggcccctggacaagggcttgagtggatgggatggatcaaccctaacaataacggcacaaactatgcacagaagtttcagggcagggtcaccatgaccagggacacgtccatcagcacagcctacatggagctgaacaggctgacatctgacgacacggccgtgtattactgtgcgagagacggtaccagcagctttgactactggggccagggaaccctggtcaccgtctcctca

SEQ ID NO: 29412 - protein, 117 aa, Artificial Sequence
  Description of Artificial Sequence: Synthetic polypeptide
QVQLVQSGAEVKKPGASVKVSCKASGYTFTGYHMHWVRQAPGQGLEWMGWINPNNNGTNYAQKFQGRVTMTRDTSISTAYMELNRLTSDDTAVYYCARDGTSSFDYWGQGTLVTVSS

SEQ ID NO: 29413 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagggcccgtattgggtactttgactcctggggccagggaaccctggtcaccgtctcctca

SEQ ID NO: 29414 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARARIGYFDSWGQGTLVTVSS

SEQ ID NO: 29415 - DNA, 351 bp, Artificial Sequence
  Description of Artificial Sequence: Synthetic polynucleotide
caggtgcagctggtggagtctgggggaggcgtggtccagccggggaggtccctgagactctcctgtgcagcgtctggattcaccttcagtaactttggcatgcactgggtccgccaggctccaggcaaggggctggagtgggtggcagttgtatggtatgatggaaataatagatactatgcagactccgtgaagggccgattcaccatctccagagacaattccaagaacacgctctatctgcaaatgcacagcctgagagccgaggacacggctgtgtattactgtgcgagggaactgggatttctctctgacttctggggccagggaaccctggtcaccgtctcctca

SEQ ID NO: 29416 - protein, 117 aa, Artificial Sequence
  Description of Artificial Sequence: Synthetic polypeptide
QVQLVESGGGVVQPGRSLRLSCAASGFTFSNFGMHWVRQAPGKGLEWVAVVWYDGNNRYYADSVKGRFTISRDNSKNTLYLQMHSLRAEDTAVYYCARELGFLSDFWGQGTLVTVSS

SEQ ID NO: 29417 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttacatggtttgatggaaataataactactatgcagactccgtgaagggccgattcaccatctccagagacaattccaagaacacgctgtatctgcaaatgaacagcctgagagccgaggacacggctgtgtattactgtgcgagagaactggggttcctttctgattattggggccagggaaccctggtcaccgtctcctca

SEQ ID NO: 29418 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVTWFDGNNNYYADSVKGRFTISRDNSKNTLYLQMNSLRAEDTAVYYCARELGFLSDYWGQGTLVTVSS

SEQ ID NO: 29419 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcacctatgccatgagttgggtccgccaggctccagggaaggggctggagtgggtctcagctattagtggtagtggtgttaacacattctacgcagactccgtgaagggccggttcaccatctccagagacaattccaagaacacgctgtttctgcaaatgaacagcctgagagccgaggacacggccgtatattactgtgcgaaactggggaaggactactactactacggtatggacgtctggggccaagggaccacggtcaccgtctcctca

SEQ ID NO: 29420 - protein, 121 aa, Artificial Sequence
  Description of Artificial Sequence: Synthetic polypeptide
EVQLLESGGGLVQPGGSLRLSCAASGFTFSTYAMSWVRQAPGKGLEWVSAISGSGVNTFYADSVKGRFTISRDNSKNTLFLQMNSLRAEDTAVYYCAKLGKDYYYYGMDVWGQGTTVTVSS

SEQ ID NO: 29421 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgatctgggtccgccaggctccagggaaggggctggagtgggtctcatccattagtggtactagtagttacatatactacgcagactcagtgaagggccgattcaccatctccagagacaacgccaagaactcactgtatctgcaaatgaacagcctgagagccgaggacacggctgtgtattactgtgcgggaatgactacagtaatttggggccagggaaccctggtcaccgtctcctca

SEQ ID NO: 29422 - protein, 114 aa, Artificial Sequence
  Description of Artificial Sequence: Synthetic polypeptide
EVQLVESGGGLVKPGGSLRLSCAASGFTFSSYSMIWVRQAPGKGLEWVSSISGTSSYIYYADSVKGRFTISRDNAKNSLYLQMNSLRAEDTAVYYCAGMTTVIWGQGTLVTVSS

SEQ ID NO: 29423 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagcagctggtcgggcggtatggacgtctggggccaagggaccacggtcaccgtctcctca

SEQ ID NO: 29424 - protein, 121 aa, Artificial Sequence; identical to SEQ ID NO: 28488
  Description of Artificial Sequence: Synthetic polypeptide

SEQ ID NO: 29425 - DNA, 351 bp, Artificial Sequence
  Description of Artificial Sequence: Synthetic polynucleotide
caggtccagctggtggagtctgggggaggcgtggtccagcctgggaggtccctgagactctcctgtacaacgtctggattcaccttcagtgactatggcatccactgggtccgccaggctccaggcaaggggctggactgggtggcagttatatggtatgatgaaaataataaatactatgcagactccgtgaagggccgattcgccatctccagagacaattccaagaacacgctgtatctgcaaatgaacagcctgagagccgaggacacggctgtgtattattgtgtgagagaactggggatgacgtctgactactggggccagggaaccctggtcaccgtctcctca

SEQ ID NO: 29426 - protein, 117 aa, Artificial Sequence
  Description of Artificial Sequence: Synthetic polypeptide
QVQLVESGGGVVQPGRSLRLSCTTSGFTFSDYGIHWVRQAPGKGLDWVAVIWYDENNKYYADSVKGRFAISRDNSKNTLYLQMNSLRAEDTAVYYCVRELGMTSDYWGQGTLVTVSS

SEQ ID NO: 29427 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgaggaaagtaataaatactatggagactccgtgaagggccgattcaccatctccagagacaattccaagaacacgctgtatctgcaaatgaacagcctgagagccgaggacacggctgtgtattactgtgcgagagaattggggttcctctctgactactggggccagggaaccctggtcaccgtctcctca

SEQ ID NO: 29428 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEESNKYYGDSVKGRFTISRDNSKNTLYLQMNSLRAEDTAVYYCARELGFLSDYWGQGTLVTVSS

SEQ ID NO: 29429 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatttccactgggtgcgacaggcccctggtcaagggcttgagtggatgggatggatccaccctaacaataatgccacaaactatgcacagaagtttcagggcagggtcaccatgaccagggacacgtccatcagcacagcctacatggagctgagcaggctgagatctgacgacacggccgtgtattactgtgcgaaggatggcagatcgtcctttgactactggggccagggaaccctggtcaccgtctcctca

SEQ ID NO: 29430 - protein, 117 aa, Artificial Sequence
  Description of Artificial Sequence: Synthetic polypeptide
QVQLVQSGAEVKKPGASVKVSCKASGYTFTGYYFHWVRQAPGQGLEWMGWIHPNNNATNYAQKFQGRVTMTRDTSISTAYMELSRLRSDDTAVYYCAKDGRSSFDYWGQGTLVTVSS

SEQ ID NO: 29431 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtagtagcacattctacgcagactccgtgaagggccggttcaccatctccagagacaattccaagaacacgctgtatctgcaaatgaacagcctgagagccgaggacacggccgttttttactgtgcgaaagatcacggtatagtgggaactatttactttgactactggggccagggaaccctggtcaccgtctcctca

SEQ ID NO: 29432 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGRGSSTFYADSVKGRFTISRDNSKNTLYLQMNSLRAEDTAVFYCAKDHGIVGTIYFDYWGQGTLVTVSS

SEQ ID NO: 29433 - DNA, 363 bp, Artificial Sequence; identical to SEQ ID NO: 29423
  Description of Artificial Sequence: Synthetic polynucleotide

SEQ ID NO: 29434 - protein, 121 aa, Artificial Sequence; identical to SEQ ID NO: 28488
  Description of Artificial Sequence: Synthetic polypeptide

SEQ ID NO: 29435 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcacttatatggtatgatggaagtaataaataccatgcagactccgtgaagggccgattcaccatctccagagacaattccaagaacacgctgtatctgcaaatgaacagcctgagagccgaggacacggctgtgtattactgcgcgagaaggtatagcagcagctggtcgggcggtatggacgtctggggccaagggaccacggtcaccgtctcctca

SEQ ID NO: 29436 - protein, 121 aa, Artificial Sequence; identical to SEQ ID NO: 29388
  Description of Artificial Sequence: Synthetic polypeptide

SEQ ID NO: 29437 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtttgatggaaataataaatactatgaagactccgtgaagggccgattcaccatctccagagacaattccaagaacacgctgtatctgcaaatgaacagcctgagagccgaggacacggctgtgtattactgtgtgagggaactgggatttctctctgactactggggccagggaaccctggtcaccgtctcctca

SEQ ID NO: 29438 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWFDGNNKYYEDSVKGRFTISRDNSKNTLYLQMNSLRAEDTAVYYCVRELGFLSDYWGQGTLVTVSS

SEQ ID NO: 29439 - DNA, 339 bp, Artificial Sequence
  Description of Artificial Sequence: Synthetic polynucleotide
gaggtgcaactggtggagtctgggggaggcctggtcaagcctggggggtccctgagactctcctgtgcagcctctggattcaccttcaatagttataggatgaactgggtccgccaggctccagggaaggggctggagtgggtctcatccattagtagtagtagtaatcacatagactacgcagactcagtgaagggccgattcaccatctccagagacaacgccaaaaactcactatatttgcaaatgaacagcctgagagccgaggacacggctttatattactgtgcgagagggactgactactggggccagggaaccctggtctccgtctcctca

SEQ ID NO: 29440 - protein, 113 aa, Artificial Sequence
  Description of Artificial Sequence: Synthetic polypeptide
EVQLVESGGGLVKPGGSLRLSCAASGFTFNSYRMNWVRQAPGKGLEWVSSISSSSNHIDYADSVKGRFTISRDNAKNSLYLQMNSLRAEDTALYYCARGTDYWGQGTLVSVSS

SEQ ID NO: 29441 - DNA, 342 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaaataataaatactatgcagactccgtgaagggccgattcaccatctccagagacaattccaagaacacgctgtatctgcaaatgaacagcctgagagccgaggacacggctgtgtattactgtacgagagaatggtttgactactggggccagggaaccctggtcaccgtctcctca

SEQ ID NO: 29442 - protein, 114 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNKYYADSVKGRFTISRDNSKNTLYLQMNSLRAEDTAVYYCTREWFDYWGQGTLVTVSS

SEQ ID NO: 29443 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaaatggcaaatattatgcagactccgtgaagggccgattcaccatctccagagacaattccaagaacacgctgtatctgcaaatgaacagcctgagagccgaggacacggctgtgtattactgtgcgagaaggtatagcagcagctggtcgggcggtatggacgtctggggccaagggaccacggtcaccgtctcctca

SEQ ID NO: 29444 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGNGKYYADSVKGRFTISRDNSKNTLYLQMNSLRAEDTAVYYCARRYSSSWSGGMDVWGQGTTVTVSS

SEQ ID NO: 29445 - DNA, 363 bp, Artificial Sequence
  Description of Artificial Sequence: Synthetic polynucleotide
caggtgcagttggtggagtctgggggaggcgtggtccagcctgggaggtccctgagactctcctgtgcagcctctggattcaccttcagtagctatggcatgcactgggtccgccaggctccaggcaaggggctggagtgggtgtcaattatatcatatggtggaagtaataaatacgatgcagactccgtgaagggccgattcaccatctccagagacaattccaagaacacgctgtatctgcaaatgaccagcctgagagctgaggacacggctgtgtattactgtgcgagacgacgggcagctcgtccagggtacggtatggacgtctggggccaagggatcacggtcaccgtctcctca

SEQ ID NO: 29446 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVSIISYGGSNKYDADSVKGRFTISRDNSKNTLYLQMTSLRAEDTAVYYCARRRAARPGYGMDVWGQGITVTVSS

SEQ ID NO: 29447 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctgcattcaccttcagtagctatggcatgcactgggtccgccagactccaggcaaggggctggagtgggtggcagttatatggcatgatggaagtaataaatactatgcagactccgtgaagggccgattcaccatctccagagacaattccaagaacacgctgtatctgcaaatgaacagcctgagagccgaggacacggctgtgtattactgtgcgagagacgagcagctcgggacctttgactactggggccagggaaccctggtcaccgtctcctca

SEQ ID NO: 29448 - protein, 118 aa, Artificial Sequence
  Description of Artificial Sequence: Synthetic polypeptide
QVQLVESGGGVVQPGRSLRLSCAASAFTFSSYGMHWVRQTPGKGLEWVAVIWHDGSNKYYADSVKGRFTISRDNSKNTLYLQMNSLRAEDTAVYYCARDEQLGTFDYWGQGTLVTVSS

SEQ ID NO: 29449 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagaacctatgccatgacctgggtccgccaggctccagggaaggggctggagtgggtctcagctatcagtggtagtggtgttaactcattctacgcagactccgtgaagggccggttcaccatctccagagacaattccgagaacacgctgtatctgcaaatgaacagcctgagagccgaggacacggccgtatattactgtgcgaaagcaagggcagtggctgggtcacactggttcgacccctggggccagggaaccctggtcaccgtctcctca

SEQ ID NO: 29450 - protein, 121 aa, Artificial Sequence
  Description of Artificial Sequence: Synthetic polypeptide
EVQLLESGGGLVQPGGSLRLSCAASGFTFRTYAMTWVRQAPGKGLEWVSAISGSGVNSFYADSVKGRFTISRDNSENTLYLQMNSLRAEDTAVYYCAKARAVAGSHWFDPWGQGTLVTVSS

SEQ ID NO: 29451 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgaagaaactaataaatactatgcagactccgtgaagggccgattcaccatctccagagacaattccaagaacacgctgtatctgcaaatgaacagcctgagaggcgaggacacggctgtgtattactgtgcgagagaagtggggttcctgaatgactactggggccagggaatcctggtcaccgtctcctca

SEQ ID NO: 29452 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYEETNKYYADSVKGRFTISRDNSKNTLYLQMNSLRGEDTAVYYCAREVGFLNDYWGQGILVTVSS

SEQ ID NO: 29453 - DNA, 369 bp, Artificial Sequence
  Description of Artificial Sequence: Synthetic polynucleotide
caggtgcagctggtgcagtctggggctgaggtgaaggagcctggggcctcagtgaaggtttcctgcaaggcatctggatacaccttcaccagttactatatacactgggtgcgacaggcccctggacaagggcttgagtggatgggagtaatcaaccctagtaatggtagaacaagctacgcacagaagttccagggcagagtcaccatgaccagggacacgtccacgagcacagtctacatggagctgagcagcctgagatctgaggacacggccgtgtattactgtgcgagagatcgaggagatggttactacttctactacggtatggacgtctggggccaagggaccacggtcaccgtctcctca

SEQ ID NO: 29454 - protein, 123 aa, Artificial Sequence
  Description of Artificial Sequence: Synthetic polypeptide
QVQLVQSGAEVKEPGASVKVSCKASGYTFTSYYIHWVRQAPGQGLEWMGVINPSNGRTSYAQKFQGRVTMTRDTSTSTVYMELSSLRSEDTAVYYCARDRGDGYYFYYGMDVWGQGTTVTVSS

SEQ ID NO: 29455 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccagactccaggcaaggggctggagtgggtggcagttatatcatatgttggaagtactaaatactatgcagactccgtgaggggccgattcaccatctccagagacaattccaagaacacgctgtatctgcaaatgaacagcctgagaactgaggacacggctgtgtattactgtgcgagagggagaggtcgatatagtgactacggtcatgatgcttttgatatctggggccaagggacaatggtcaccgtctcttca

SEQ ID NO: 29456 - protein, 124 aa, Artificial Sequence
  Description of Artificial Sequence: Synthetic polypeptide
QVQLVESGGGVVQPGRSLRLSCAASGFTFSSYGMHWVRQTPGKGLEWVAVISYVGSTKYYADSVRGRFTISRDNSKNTLYLQMNSLRTEDTAVYYCARGRGRYSDYGHDAFDIWGQGTMVTVSS

SEQ ID NO: 29457 - DNA, 354 bp, Artificial Sequence
  Description of Artificial Sequence: Synthetic polynucleotide
caggtacagctggtgcagtctggggctgaggtgaagaagcctggggcctcagtgaaggtctcctgcaaggcttctggatacaccttcaccaattatgatatcaactgggtgcgacaggccactggacaagggcttgagtggctgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcatatagcagtggctggtacgtttttgactactggggccagggaaccctggtcaccgtctcctca

SEQ ID NO: 29458 - protein, 118 aa, Artificial Sequence
  Description of Artificial Sequence: Synthetic polypeptide
QVQLVQSGAEVKKPGASVKVSCKASGYTFTNYDINWVRQATGQGLEWLGWMHPNSGNTGYAQKFQGRVTMTRNTSISTAYMELSSLRSEDTAVYYCAYSSGWYVFDYWGQGTLVTVSS

SEQ ID NO: 29459 - DNA, 342 bp, Artificial Sequence
  Description of Artificial Sequence: Synthetic polynucleotide
gaggtgcagctggtggagtctgggggaggcctggtcaagtttggggggtccctgagactctcctgtgcagcctctggattcaccttcagtagctatagcatgaactgggtccgccaggctccagggaaggggctggagtgggtctcatccattagtagtagtagtacttacatatactacggagactcagtgaagggccgattcaccatctcccgagacaacgccaagaactcactatatctgcagatgaacagcctgagagccgaggacacggctgtgtattactgtgcgagagatcggggcagcagctggggccagggaaccctggtcaccgtctcctca

SEQ ID NO: 29460 - protein, 114 aa, Artificial Sequence
  Description of Artificial Sequence: Synthetic polypeptide
EVQLVESGGGLVKFGGSLRLSCAASGFTFSSYSMNWVRQAPGKGLEWVSSISSSSTYIYYGDSVKGRFTISRDNAKNSLYLQMNSLRAEDTAVYYCARDRGSSWGQGTLVTVSS

SEQ ID NO: 29461 - DNA, 360 bp, Artificial Sequence; identical to SEQ ID NO: 29399
  Description of Artificial Sequence: Synthetic polynucleotide

SEQ ID NO: 29462 - protein, 120 aa, Artificial Sequence; identical to SEQ ID NO: 29400
  Description of Artificial Sequence: Synthetic polypeptide

SEQ ID NO: 29463 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactatatctgcaaatgaacagcctgagagccgaggacacggctgtgtattactgtgcgagagtggctacttttgactactggggccagggaaccctggtcaccgtctcctca

SEQ ID NO: 29464 - protein, 115 aa, Artificial Sequence; identical to SEQ ID NO: 29342
  Description of Artificial Sequence: Synthetic polypeptide

SEQ ID NO: 29465 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgccaggcttctggatacaccttcaccggctaccatatgcactgggtgcgacaggcccctggacaagggcttgagtggatgggatggatcaaccctaacaataatgccacaaactatgcacagaagtttcagggcagggtcaccatgaccagggacacgtccatcagcacagcctacatggaactgaggaggctgagatctgacgacacggccgtgtatcactgtgcgagagatggcacctcgtcttttgactactggggccagggaaccctggtcaccgtctcctca

SEQ ID NO: 29466 - protein, 117 aa, Artificial Sequence
  Description of Artificial Sequence: Synthetic polypeptide
QVQLVQSGAEVKKPGASVKVSCQASGYTFTGYHMHWVRQAPGQGLEWMGWINPNNNATNYAQKFQGRVTMTRDTSISTAYMELRRLRSDDTAVYHCARDGTSSFDYWGQGTLVTVSS

SEQ ID NO: 29467 - DNA, 354 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggcatgatggaagtaataaatattatgtagactccgtgaagggccgattcaccatctccagagacaattccaagaatacgctgtatctgcaaatgaacagcctgagagccgaggacacggctgtgtattactgtgcgagagacgagcagctcgggacctttgactactggggccagggaaccctggtcaccgtctcctca

SEQ ID NO: 29468 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWHDGSNKYYVDSVKGRFTISRDNSKNTLYLQMNSLRAEDTAVYYCARDEQLGTFDYWGQGTLVTVSS

SEQ ID NO: 29469 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactaccatatgcactgggtgcgacaggcccctggacaagggcttgagtggatgggatggatcaaccctaacagaggtggcacaaattatgtacagaagtttcagggtagggtcgccatgaccaatgacacgtccatcagcacagcctatatggagctgagtgggctgagatctgacgacacggccgtgtattactgtgcgagagatggcacctcgtcttttgactattggggccggggaaccctggtcaccgtctcctca

SEQ ID NO: 29470 - protein, 117 aa, Artificial Sequence
  Description of Artificial Sequence: Synthetic polypeptide
QVQLVQSGAEVKKPGASVKVSCKASGYTFTDYHMHWVRQAPGQGLEWMGWINPNRGGTNYVQKFQGRVAMTNDTSISTAYMELSGLRSDDTAVYYCARDGTSSFDYWGRGTLVTVSS

SEQ ID NO: 29471 - DNA, 360 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggattcaccttcaccgactactatatgcactgggtgcgacaggcccctggacaagggcttgagtggatgggatggatcaaccctaacagtggtggcacaaactatgcacagaggtttcagggcagggtcaccatgaccagggacacgtccatcagcacagcctacatggaactgagcagactgagatctgacgacacggccgtgtattactgtacgagagagggagcaactcgtccgacgggttttgactactggggccagggaaccctggtcaccgtctcctca

SEQ ID NO: 29472 - protein, 120 aa, Artificial Sequence
  Description of Artificial Sequence: Synthetic polypeptide
QVQLVQSGAEVKKPGASVKVSCKASGFTFTDYYMHWVRQAPGQGLEWMGWINPNSGGTNYAQRFQGRVTMTRDTSISTAYMELSRLRSDDTAVYYCTREGATRPTGFDYWGQGTLVTVSS

SEQ ID NO: 29473 - DNA, 375 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggccactatataaactgggtgcgacaggcccctggacaagggcttgagtggatggcatgggtcaaccctaacagtggtggcacaaactctgcacagaagtttcagggcagggtcaccatgaccagggacacgtccatcagcacagtctacatggagctgagcaggctgagatctgacgacacggccgtgtattactgtgcgaggggagggcagctcggcgggtttaactactactactacggtatggacgtctggggccaagggaccacggtcaccgtctcctca

SEQ ID NO: 29474 - protein, 125 aa, Artificial Sequence
  Description of Artificial Sequence: Synthetic polypeptide
QVQLVQSGAEVKKPGASVKVSCKASGYTFTGHYINWVRQAPGQGLEWMAWVNPNSGGTNSAQKFQGRVTMTRDTSISTVYMELSRLRSDDTAVYYCARGGQLGGFNYYYYGMDVWGQGTTVTVSS

SEQ ID NO: 29475 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaagtaataaacactatgcagactccgtgaagggccgattcaccatctccagagacaattccaagaccacgctgtatctgcaaatgagcagcctgagagccgaggacacggctgtgtattattgttcgagagaactggggatgaacggagactactggggccagggaaccctggtcaccgtctcctca

SEQ ID NO: 29476 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDESNKHYADSVKGRFTISRDNSKTTLYLQMSSLRAEDTAVYYCSRELGMNGDYWGQGTLVTVSS

SEQ ID NO: 29477 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggcggtatagcagcagctgggacgggggtatggacgtctggggccaagggaccacggtcaccgtctcctca

SEQ ID NO: 29478 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRYSSSWDGGMDVWGQGTTVTVSS

SEQ ID NO: 29479 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaatgactatggcatgcactgggtccgccaggctccaggcaaggggctggagtgggtggcaattatatggtatgatgaaaataataaatactatgcagactccgtgaagggccgattcaccatctccagagacaattccaagaacacgctgtatctgcaaatgagcagcctgagagccgaggacacggctgtatattactgtgcgagagatgttctggacccttttgactactggggccagggaaccctggtcaccgtctcctca

SEQ ID NO: 29480 - protein, 117 aa, Artificial Sequence
  Description of Artificial Sequence: Synthetic polypeptide
QVQLVESGGGVVQPGRSLRLSCAASGFTFNDYGMHWVRQAPGKGLEWVAIIWYDENNKYYADSVKGRFTISRDNSKNTLYLQMSSLRAEDTAVYYCARDVLDPFDYWGQGTLVTVSS

SEQ ID NO: 29481 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagaagctggacgggaggcatggacgtctggggccaagggaccacggtcaccgtctcctca

SEQ ID NO: 29482 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRYSRSWTGGMDVWGQGTTVTVSS

SEQ ID NO: 29483 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgaagaaagtaataaatactatgcagactccgtgaagggccgattcaccatctccagagacaattccaagaacacgctgtatctgcaaatgaacagcctgagagccgaggacacggctgtatattactgtgcgagagaactggggatgaccggagactactggggccagggaaccctggtcaccgtctcctca

SEQ ID NO: 29484 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYEESNKYYADSVKGRFTISRDNSKNTLYLQMNSLRAEDTAVYYCARELGMTGDYWGQGTLVTVSS

SEQ ID NO: 29485 - DNA, 375 bp, Artificial Sequence
  Description of Artificial Sequence: Synthetic polynucleotide
caggtgcaactagtgcagtctggggctgaggtgaagaagcctggggcctcagtgaaggtctcctgcaaggcttctggatacagtttcaccggccactatatacactgggtgcgacaggcccctggacaagggcttgagtacatgggatggatcaaccctaacagcggtggcacaaactatgtacagaaatttcagggcagggtcaccatgaccagggacacgtccatcagcacagcctacatggagctgagcaggctgagatctgacgacacggccatatattactgttcgagagggggcctactgggagctaccaactactattattacggtatggacgtctggggccaagggaccacggtcaccgtctcctca

SEQ ID NO: 29486 - protein, 125 aa, Artificial Sequence
  Description of Artificial Sequence: Synthetic polypeptide
QVQLVQSGAEVKKPGASVKVSCKASGYSFTGHYIHWVRQAPGQGLEYMGWINPNSGGTNYVQKFQGRVTMTRDTSISTAYMELSRLRSDDTAIYYCSRGGLLGATNYYYYGMDVWGQGTTVTVSS

SEQ ID NO: 29487 - DNA, 354 bp, Artificial Sequence
  Description of Artificial Sequence: Synthetic polynucleotide
caggtgctgctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtacttctttgactactggggccagggaaccctggtcaccgtctcctca

SEQ ID NO: 29488 - protein, 118 aa, Artificial Sequence
  Description of Artificial Sequence: Synthetic polypeptide
QVLLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYFFDYWGQGTLVTVSS

SEQ ID NO: 29489 - DNA, 345 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgtcatgagctgggtccgccaggctccagggaaggggctggagtgggtctcatctattagtggtagtggtggttggacaaactacgcagactccgtgaagggccgattcaccacctccagagacaattccaagaacacgctgtatctgcaaatgaacagcctgagagccgaggacacggccgtttattactgtgcgagactaactggatttgactattggggccagggaaccctggtcaccgtctcctca

SEQ ID NO: 29490 - protein, 115 aa, Artificial Sequence
  Description of Artificial Sequence: Synthetic polypeptide
EVQLLESGGGLVQPGGSLRLSCAASGFTFSSYVMSWVRQAPGKGLEWVSSISGSGGWTNYADSVKGRFTTSRDNSKNTLYLQMNSLRAEDTAVYYCARLTGFDYWGQGTLVTVSS

SEQ ID NO: 29491 - DNA, 339 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgtcatgagctgggtccgccaggctccagggaaggggctggagtgggtctcaggtattagtggtagtggtaatagaacatactacgcagactccgtgaagggccggttcaccatctccagagacaattccaagaatacgctgtatctgcaaatgaacagcctgagagccgaggactcggccgtttattactgtgggagtttggggattgactggggccagggaaccctggtcaccgtctcctca

SEQ ID NO: 29492 - protein, 113 aa, Artificial Sequence
  Description of Artificial Sequence: Synthetic polypeptide
EVQLLESGGGLVQPGGSLRLSCAASGFTFSSYVMSWVRQAPGKGLEWVSGISGSGNRTYYADSVKGRFTISRDNSKNTLYLQMNSLRAEDSAVYYCGSLGIDWGQGTLVTVSS

SEQ ID NO: 29493 - DNA, 357 bp, Artificial Sequence
  Description of Artificial Sequence: Synthetic polynucleotide
caggtgcagctgcaggagtcgggcccaggactggtgaggccttcggcgaccctgtccctcacctgcactgtctctggtggctccatcagcaggagtagttactactggggctggatccgccagcccccagggaagggactggagtggattgggagtatctattatagtgggagcgcctcctacaacccgtccctcaagagtcgagtcaccatatccgtagacacgtccgagaaccaattctccctgaggctgagctctgtgaccgccgcagacacggctgtgtattactgtgcgagactggacagtggctggtcgtttgactactggggccagggaaccctggtcaccgtctcctca

SEQ ID NO: 29494 - protein, 119 aa, Artificial Sequence
  Description of Artificial Sequence: Synthetic polypeptide
QVQLQESGPGLVRPSATLSLTCTVSGGSISRSSYYWGWIRQPPGKGLEWIGSIYYSGSASYNPSLKSRVTISVDTSENQFSLRLSSVTAADTAVYYCARLDSGWSFDYWGQGTLVTVSS

SEQ ID NO: 29495 - DNA, 363 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtaacacattctacgcagactccgtgaagggccggttcaccatctccagagacaattccaagaacacgctgtttcttcaaatgaacagcctgagagccgaggacacggccgtatattactgtgcgaaatttttcggtatagtgggagccgggtactttgactactggggccagggaaccctggtcaccgtctcctca

SEQ ID NO: 29496 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGNTFYADSVKGRFTISRDNSKNTLFLQMNSLRAEDTAVYYCAKFFGIVGAGYFDYWGQGTLVTVSS

SEQ ID NO: 29497 - DNA, 363 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagcaactatgccatgacctgggtccgccaggctccagggaaggggctggagtgggtctcagctattagtggtagtggtggtaacacattctacgcagactccgtgacgggccgggtcaccatctccagagacaattccaagaacacgctgtatctgcaaatgaacagtctgagagccgaggacacggccgtatattactgtgcgaaactggggaaggactaccactactacggtatggacgtctggggccaagggaccacggtcaccgtctcctca

SEQ ID NO: 29498 - protein, 121 aa, Artificial Sequence
  Description of Artificial Sequence: Synthetic polypeptide
EVQLLESGGGLVQPGGSLRLSCAASGFTFSNYAMTWVRQAPGKGLEWVSAISGSGGNTFYADSVTGRVTISRDNSKNTLYLQMNSLRAEDTAVYYCAKLGKDYHYYGMDVWGQGTTVTVSS

SEQ ID NO: 29499 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgtagactccgtgaagggccgattcaccatctccagagacaattccaagaacacgctgtatctgcaaatgaacagcctgagagccgaggacacggctgtgtattactgtgcgagaaggtatagcagaagctggacgggaggtatggacgtctggggccaggggaccacggtcaccgtctcctca

SEQ ID NO: 29500 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYVDSVKGRFTISRDNSKNTLYLQMNSLRAEDTAVYYCARRYSRSWTGGMDVWGQGTTVTVSS

SEQ ID NO: 29501 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttacttctggagctggatccggcagcccgccgggaagggactggagtggattgggcgcatctataccagggggagcaccaactacaacccctccctcaagagtcgagtcaccatgtcagtagacacgtccaagaaccagttctccctgaagctgagctctgtgaccgccgcggacacggccgtgtattactgtgcgagagagggaaaaactgggggggtttcttactttgactactggggccagggaaccctggtcaccgtctcctca

SEQ ID NO: 29502 - protein, 120 aa, Artificial Sequence
  Description of Artificial Sequence: Synthetic polypeptide
QVQLQESGPGLVKPSETLSLTCTVSGGSISSYFWSWIRQPAGKGLEWIGRIYTRGSTNYNPSLKSRVTMSVDTSKNQFSLKLSSVTAADTAVYYCAREGKTGGVSYFDYWGQGTLVTVSS

SEQ ID NO: 29503 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagtcacttctggagctggatccggcagcccgccgggaagggactggagtggattgggcgcatctatatcagggggagcaccaactacaacccctccctcaagagtcgagtcaccatgtcagtagacacgtccaagaaccagttctccctgaagctgagctctgtgaccgccgcggacacggccgtgtattactgtgcgagagagggaaaaactgggggggtttcttactttgactactggggccagggaaccctggtcaccgtctcctca

SEQ ID NO: 29504 - protein, 120 aa, Artificial Sequence
  Description of Artificial Sequence: Synthetic polypeptide
QVQLQESGPGLVKPSETLSLTCTVSGGSISSHFWSWIRQPAGKGLEWIGRIYIRGSTNYNPSLKSRVTMSVDTSKNQFSLKLSSVTAADTAVYYCAREGKTGGVSYFDYWGQGTLVTVSS

SEQ ID NO: 29505 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaatgactatggcatgcactgggtccgccaggctccaggcaaggggctggagtgggtggcaattatatggtatgatgaaagtaataaatactatgcagactccgtgaagggccgattcaccatctccagagacaattccaagaacacgctgtatctgcaaatgaacagcctgagagccgaggacacggctgtatattactgtgcgagagatgttctggacccttttgactactggggccagggaaccctggtcaccgtctcctca

SEQ ID NO: 29506 - protein, 117 aa, Artificial Sequence
  Description of Artificial Sequence: Synthetic polypeptide
QVQLVESGGGVVQPGRSLRLSCAASGFTFNDYGMHWVRQAPGKGLEWVAIIWYDESNKYYADSVKGRFTISRDNSKNTLYLQMNSLRAEDTAVYYCARDVLDPFDYWGQGTLVTVSS

SEQ ID NO: 29507 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtatagcagtggctggtacgactacggtatggacgtctggggccaagggaccacggtcaccgtctcctca

SEQ ID NO: 29508 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARERYSSGWYDYGMDVWGQGTTVTVSS

SEQ ID NO: 29509 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagaagctgggcgggaggcatggacgtctggggccaagggaccacggtcaccgtctcctca

SEQ ID NO: 29510 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRYSRSWAGGMDVWGQGTTVTVSS

SEQ ID NO: 29511 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgacccctaacagtggtaacacaggctatgcacagaagttccagggcagagtcaccatgaccaggaacacctccataagcacagcctacatggagctgagcagcctgaaatctgaggacacggccgtgtattactgtgcgtatagcagtggctggtaccgctttgactactggggccagggaaccctggtcaccgtctcctca

SEQ ID NO: 29512 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMTPNSGNTGYAQKFQGRVTMTRNTSISTAYMELSSLKSEDTAVYYCAYSSGWYRFDYWGQGTLVTVSS

SEQ ID NO: 29513 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtagcacaggctatgcacagaagttccagggcagagtcaccatgaccaggaacacctccataagcacagcctacatggagctgagcagcctgagatctgaggacacggccgtgtattactgtgcgtatagcagtggctggtactactttgactactggggccagggaaccctggtcaccgtctcctca

SEQ ID NO: 29514 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGSTGYAQKFQGRVTMTRNTSISTAYMELSSLRSEDTAVYYCAYSSGWYYFDYWGQGTLVTVSS

SEQ ID NO: 29515 - DNA, 363 bp, Artificial Sequence
  Description of Artificial Sequence: Synthetic polynucleotide
gaggtgcagctgttggagtctgggggaggcttggttcagcctggggggtccctgagactctcctgtgcagcctctggattcacctttagcagctatgccatgagttgggtccgccaggctccagggaaggggctggagtgggtctcagctattagtactggtggtggtaacacatactacgcagactccgtgaagggccggttcaccatttccagagacaattccaagaacacgctgtatctgcaaatgaacagcctgagagccgaggacacggccgtatattactgtgcgaaacggggggtctacggtgactttgatgcttttgatatctggggccaagggacaatggtcaccgtctcttca

SEQ ID NO: 29516 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISTGGGNTYYADSVKGRFTISRDNSKNTLYLQMNSLRAEDTAVYYCAKRGVYGDFDAFDIWGQGTMVTVSS

SEQ ID NO: 29517 - DNA, 351 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagaagctatgccatgagctgggtccgccaggctccagggaaggggctggagtgggtctcagctactagtggtagtggtgttaacacattctacgcagactccgtgaagggccggttcaccatctccagagacaattccaagaacacgctgtatctgcaaatgaacagcctgagagccgaggacacggccgtatattactgtgcgaaattggaactggggatctttgactactggggccagggaaccctggtcaccgtctcctca

SEQ ID NO: 29518 - protein, 117 aa, Artificial Sequence
  Description of Artificial Sequence: Synthetic polypeptide
EVQLLESGGGLVQPGGSLRLSCAASGFTFRSYAMSWVRQAPGKGLEWVSATSGSGVNTFYADSVKGRFTISRDNSKNTLYLQMNSLRAEDTAVYYCAKLELGIFDYWGQGTLVTVSS

SEQ ID NO: 29519 - DNA, 339 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaagggactggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgatttttggagtggactggggccagggaaccctggtcaccgtctcctca

SEQ ID NO: 29520 - protein, 113 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAIFGVDWGQGTLVTVSS

SEQ ID NO: 29521 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggccaggggctggagtggatggcaattatatggtatgatggaagtaataaatactatgcagactccgtgaagggccgattcaccatctccagagacaattccaagaacacgctgtatctgcaaatcaacagcctgagagccgaggacacggctgtgtattactgtgcgagagaagacccgcgtaccagctgctctgactactggggccagggaaccctggtcaccgtctcctca

SEQ ID NO: 29522 - protein, 119 aa, Artificial Sequence
  Description of Artificial Sequence: Synthetic polypeptide
QVQLVESGGGVVQPGRSLRLSCAASGFTFSSYGMHWVRQAPGQGLEWMAIIWYDGSNKYYADSVKGRFTISRDNSKNTLYLQINSLRAEDTAVYYCAREDPRTSCSDYWGQGTLVTVSS

SEQ ID NO: 29523 - DNA, 357 bp, Artificial Sequence
  Description of Artificial Sequence: Synthetic polynucleotide
caggtgtatctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactctgcagactccgtgaagggccgattcaccatctccagagacaattccaagaacacgctggatctgcaaatgaacagcctgagagccgaggacacggctgtgtattactgtgcgagagataatggtaactggaactaccttgactactggggccagggaaccctggtcaccgtctcctca

SEQ ID NO: 29524 - protein, 119 aa, Artificial Sequence
  Description of Artificial Sequence: Synthetic polypeptide
QVYLVESGGGVVQPGRSLRLSCAASGFTFSSYGMHWVRQAPGKGLEWVAVIWYDGSNKYSADSVKGRFTISRDNSKNTLDLQMNSLRAEDTAVYYCARDNGNWNYLDYWGQGTLVTVSS

SEQ ID NO: 29525 - DNA, 357 bp, Artificial Sequence
  Description of Artificial Sequence: Synthetic polynucleotide
cagctgcagctgcaggagtcgggcccaggactggtgaagccttcggagaccctgtccctcacctgtattgtctctggtggctccatcagcagaagtagttactactggggctggatccgccagcccccagggaaggggctggagtggattgggagcatctattatagtgggatcgcctcctataatccgtccctcaagagtcgagtcaccatatccgtagacacgtccaagaaccagttctccctgaagctgaactctgtgaccgccacagacacggctgtatattactgtgcgagactgagcagtggctggtcctttgactactggggccagggaaccctggtcaccgtctcctca

SEQ ID NO: 29526 - protein, 119 aa, Artificial Sequence
  Description of Artificial Sequence: Synthetic polypeptide
QLQLQESGPGLVKPSETLSLTCIVSGGSISRSSYYWGWIRQPPGKGLEWIGSIYYSGIASYNPSLKSRVTISVDTSKNQFSLKLNSVTATDTAVYYCARLSSGWSFDYWGQGTLVTVSS

SEQ ID NO: 29527 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtatattactgtgcgagggttaactcttttgactcctggggccagggaaccctggtcaccgtctcctca

SEQ ID NO: 29528 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVNSFDSWGQGTLVTVSS

SEQ ID NO: 29529 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatagaagtaataaatactatgcagactccgtgaagggccgattcaccatctccagagacaattccaagaacacgctgtatctgcaaatgaacagcctgagagtcgaggacacggctgtgtatcactgtgcgagagagcttgggttcagcagtgactactggggccagggaaccctggtcaccgtctcctca

SEQ ID NO: 29530 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDRSNKYYADSVKGRFTISRDNSKNTLYLQMNSLRVEDTAVYHCARELGFSSDYWGQGTLVTVSS

SEQ ID NO: 29531 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttcctatggcatgcactgggtccgccaggctccaggcaaggggctggagtgggtggcagctatatggtatgatggaagtaataaatactatggagactccgtgaagggccgagtcaccatctccagagacaattccaagaactcgctgcatctgcaaatgaacagcctgagagccgaggacacggctgtgtattattgtgcgagagatcagggcatagtgggagctacttggtttgactactggggccagggaaccctggtcaccgtctcctca

SEQ ID NO: 29532 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAAIWYDGSNKYYGDSVKGRVTISRDNSKNSLHLQMNSLRAEDTAVYYCARDQGIVGATWFDYWGQGTLVTVSS

SEQ ID NO: 29533 - DNA, 360 bp, Artificial Sequence
  Description of Artificial Sequence: Synthetic polynucleotide
gaggtgcagctgttggagtctgggggaggcttggttcagcctggggggtccctgagactctcctgtgcagcctctggattcacctttagcagctatgttatgagctgggtccgccaggctccagggaaggggctggagtgggtctcaggtattagtggtagtggtgctaaaacatactatgcagactccgtgaagggccgattcaccatctccagagacaattccaagaacacgctgtatctgcaaatgaacagcctgagagccgaggacacggccgtatattactgtgcggaactggggatagactactactacggtatggacgtctggggccaagggaccacggtcaccgtctcctca

SEQ ID NO: 29534 - protein, 120 aa, Artificial Sequence
  Description of Artificial Sequence: Synthetic polypeptide
EVQLLESGGGLVQPGGSLRLSCAASGFTFSSYVMSWVRQAPGKGLEWVSGISGSGAKTYYADSVKGRFTISRDNSKNTLYLQMNSLRAEDTAVYYCAELGIDYYYGMDVWGQGTTVTVSS

SEQ ID NO: 29535 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaaggacttgagtggatgggatggatcaaacctaaaagtggtggcacaaaccaagcacagaagtttcagggcagggtcaccatgaccagggacacgtccatcagcacagcctacatggagctgagcagtctgagatctgacgacacggccgtgtattactgtgcgagagctccgggtatagcagcagctggtacatggggatactttgactactggggccagggaaccctggtcaccgtctcctca

SEQ ID NO: 29536 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWIKPKSGGTNQAQKFQGRVTMTRDTSISTAYMELSSLRSDDTAVYYCARAPGIAAAGTWGYFDYWGQGTLVTVSS

SEQ ID NO: 29537 - DNA, 345 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgtcttaaactgggtccgccaggctccagggaaggggctggagtgggtctcagctatgagtggtagtggtggtagaacatactacgcagactccgtgaagggccggttcaccatctccagagacaattccaagaacacgctgtatctgcaaatgaacagcctgagagccgaggacacggccgtatatttctgtgcgatgactacgcactttgactactggggccagggaaccctggtcaccgtctcctca

SEQ ID NO: 29538 - protein, 115 aa, Artificial Sequence
  Description of Artificial Sequence: Synthetic polypeptide
EVQLLESGGGLVQPGGSLRLSCAASGFTFSSYVLNWVRQAPGKGLEWVSAMSGSGGRTYYADSVKGRFTISRDNSKNTLYLQMNSLRAEDTAVYFCAMTTHFDYWGQGTLVTVSS

SEQ ID NO: 29539 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattctccttcagtagctatagcatgaactgggtccgccaggctccagggaaggggctggagtgggtctcatccattagtagtagtagtacttacatatactacggagactcagtgaagggccgattcaccatctccagagacaacgccaagaactcactgtatctgcaaatgaacagcctgagagccgaggacacggctgtgtattactgtgcgagagatcggggcagcagctggggccagggaaccctggtcaccgtctcctca

SEQ ID NO: 29540 - protein, 114 aa, Artificial Sequence
  Description of Artificial Sequence: Synthetic polypeptide
EVQLVESGGGLVKPGGSLRLSCAASGFSFSSYSMNWVRQAPGKGLEWVSSISSSSTYIYYGDSVKGRFTISRDNAKNSLYLQMNSLRAEDTAVYYCARDRGSSWGQGTLVTVSS

SEQ ID NO: 29541 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacataaactacacagactcagtgaagggccgattcaccatctccagagacaacgccaagaactcactgtatctgcaaatgaacagcctgagagccgaggacacggctgtgtattactgtgcgagagtggctggctttgactactggggccagggaaccctggtcaccgtctcctca

SEQ ID NO: 29542 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYINYTDSVKGRFTISRDNAKNSLYLQMNSLRAEDTAVYYCARVAGFDYWGQGTLVTVSS

SEQ ID NO: 29543 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgcatctataccagggggagcaccaactacaacccctccctcaagagtcgagtcaccatgtcaatagacacgtccaagaaccagttctccctgaagctgagctctgtgaccgccgcggacacggccgtgtattactgtgcgagagagggaaaaactgggggggtttcttactttgactactggggccagggaaccctggtcaccgtctcctca

SEQ ID NO: 29544 - protein, 120 aa, Artificial Sequence
  Description of Artificial Sequence: Synthetic polypeptide
QVQLQESGPGLVKPSETLSLTCTVSGGSISSYYWSWIRQPAGKGLEWIGRIYTRGSTNYNPSLKSRVTMSIDTSKNQFSLKLSSVTAADTAVYYCAREGKTGGVSYFDYWGQGTLVTVSS

SEQ ID NO: 29545 - DNA, 363 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcagctatatggtatgatggaagtaataaatactatgcagactccgtgaagggccgattcaccatctccagagacaattccaagaacacgctgtatctgcaaatgaacagcctgagagccgaggacacggctgtgtattactgtgcgagagattatggtatagtgggagctacatattttgactactggggccagggaaccctggtcaccgtctcctca

SEQ ID NO: 29546 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAAIWYDGSNKYYADSVKGRFTISRDNSKNTLYLQMNSLRAEDTAVYYCARDYGIVGATYFDYWGQGTLVTVSS

SEQ ID NO: 29547 - DNA, 351 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtgactatggcatgcactgggtccgccaggctccaggcaaggggctggagtgggtggcagttatatggtatgctggaagtaataaatactatgtagactccgtgaagggccgattcaccatctccagagacaattccaagaacacgctgtatctgcaaatgaacagcctgagagccgaggacacggctgtgtattactgtgcgagggaactggggatgaggtctgactactggggccagggaaccctggtcaccgtctcctca

SEQ ID NO: 29548 - protein, 117 aa, Artificial Sequence
  Description of Artificial Sequence: Synthetic polypeptide
QVQLVESGGGVVQPGRSLRLSCVASGFTFSDYGMHWVRQAPGKGLEWVAVIWYAGSNKYYVDSVKGRFTISRDNSKNTLYLQMNSLRAEDTAVYYCARELGMRSDYWGQGTLVTVSS

SEQ ID NO: 29549 - DNA, 354 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagcagctatgccatgagctgggtccgccaggctccagggaaggggctggagtgggtctcagttattagtggtagtggtggtagtacattctacgcagactccgtgaagggccggttcaccatctccagagacaattccaagaccacgctgtatctgcaaatgaacagcctgagagccgaggacacggccgtatattactgtgcgaaaagggactggaacgacgtttttgactactggggccagggaaccctggtcaccgtctcctca

SEQ ID NO: 29550 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSVISGSGGSTFYADSVKGRFTISRDNSKTTLYLQMNSLRAEDTAVYYCAKRDWNDVFDYWGQGTLVTVSS

SEQ ID NO: 29551 - DNA, 339 bp, Artificial Sequence
  Description of Artificial Sequence: Synthetic polynucleotide
caggtgcagctggtggagtctgggggaggcttggtcaagcctggagggtccctgagactgtcctgtgcagcctctggattcatcttcagtgactactacatgaactggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagatatgattacgtggggccagggaaccctggtcaccgtctcctca

SEQ ID NO: 29552 - protein, 113 aa, Artificial Sequence
  Description of Artificial Sequence: Synthetic polypeptide
QVQLVESGGGLVKPGGSLRLSCAASGFIFSDYYMNWIRQAPGKGLEWVSYISSSGSTIYYADSVKGRFTISRDNAKNSLYLQMNSLRAEDTAVYYCARDMITWGQGTLVTVSS

SEQ ID NO: 29553 - DNA, 351 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctaccatatacactgggtgcgacaggcccctggacaagatcttgagtggatgggatggatcaaccctaacaataatggcacaaactatgcacagaagtttcagggcagggtcaccatgaccagggacacgtccatcagcacagcctacatggagctgagcaggctgagatctgacgacacggccgtgtattactgtgcgagagatgggagaagtggttttgactactggggccagggaaccctggtcaccgtctcctca

SEQ ID NO: 29554 - protein, 117 aa, Artificial Sequence
  Description of Artificial Sequence: Synthetic polypeptide
QVQLVQSGAEVKKPGASVKVSCKASGYTFTGYHIHWVRQAPGQDLEWMGWINPNNNGTNYAQKFQGRVTMTRDTSISTAYMELSRLRSDDTAVYYCARDGRSGFDYWGQGTLVTVSS

SEQ ID NO: 29555 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtaacacattctacgcagactccgtgaagggccggttcaccatctccagagacaattccaagaacacgctgtatttgcaaatgaacagcctgagagccgaggacacggccgtatattactgtgcgaaatttttcggtgtagtgggagtcgggtgctttgactactggggccagggaaccctggtcaccgtctcctca

SEQ ID NO: 29556 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGNTFYADSVKGRFTISRDNSKNTLYLQMNSLRAEDTAVYYCAKFFGVVGVGCFDYWGQGTLVTVSS

SEQ ID NO: 29557 - DNA, 351 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagaagctatgccatgagctgggtccgccaggctccagggaaggggctggagtgggtctcagctattagtggtagtggtggtaacacattctacgcagactccgtgaagggccggttcaccatctccagagacaattccaagaacacgctgtatctgcaaatgaacagcctgagagccgaggacacggccgtatattactgtgcgaaattggaactggggatctttgactactggggccagggaaccctggtcaccgtctcctca

SEQ ID NO: 29558 - protein, 117 aa, Artificial Sequence
  Description of Artificial Sequence: Synthetic polypeptide
EVQLLESGGGLVQPGGSLRLSCAASGFTFRSYAMSWVRQAPGKGLEWVSAISGSGGNTFYADSVKGRFTISRDNSKNTLYLQMNSLRAEDTAVYYCAKLELGIFDYWGQGTLVTVSS

SEQ ID NO: 29559 - DNA, 363 bp, Artificial Sequence
  Description of Artificial Sequence: Synthetic polynucleotide
gaggtgcagctgttggagtctgggggaggcttggtacagccgggggggtccctgagactctcctgtgtagtctctggattcacctttagcaactatgccatgagctgggtccgccaggctccagggaaggggctggagtgggtctcagctagcagtggtagtggtggtaacacattctacgcagactccgtgacgggccgggtcaccatctccagagacaattccaagaacacgctgtatctgcaaatgaacagtctgagagccgaggacacggccgtatattactgtgcgaaactggggaaggactaccactactacggtatggacgtctggggccaagggaccacggtcaccgtctcctca

SEQ ID NO: 29560 - protein, 121 aa, Artificial Sequence
  Description of Artificial Sequence: Synthetic polypeptide
EVQLLESGGGLVQPGGSLRLSCVVSGFTFSNYAMSWVRQAPGKGLEWVSASSGSGGNTFYADSVTGRVTISRDNSKNTLYLQMNSLRAEDTAVYYCAKLGKDYHYYGMDVWGQGTTVTVSS

SEQ ID NO: 29561 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtgttaacacaggctatgcacagaagttccagggcagagtcaccatgaccagggacacctccataagcacagcctacatggagctgagcagcctgagatctgaggacacggccgtgtattactgtgcgatcagcagtggctggaactggttcgacccctggggccagggaaccctggtcaccgtctcctca

SEQ ID NO: 29562 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSVNTGYAQKFQGRVTMTRDTSISTAYMELSSLRSEDTAVYYCAISSGWNWFDPWGQGTLVTVSS

SEQ ID NO: 29563 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgataagcagtggctggtaccggttcgacccctggggccagggaaccctggtcaccgtctcctca

SEQ ID NO: 29564 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAISSGWYRFDPWGQGTLVTVSS

SEQ ID NO: 29565 - DNA, 363 bp, Artificial Sequence
  Description of Artificial Sequence: Synthetic polynucleotide
gaggtgcagctgttggagtctgggggaggcttggtacagccgggggggtccctgagactctcctgtgcagcctctggattaacgtttagtagctacgccatgagctgggtccgccaggatccagggaaggggctggagtgggtctcagctattagtggtagtggtggtaacacattctacggagactccgtgaagggccggttcaccatctccagagacaattccaagaaaacgctgtatctgcaaatgaacagcctgagagccgaggacacggccgtatattactgtgcgaaatttttcggtatagtgggtgccgggtactttgactactggggccagggaaccctggtcaccgtctcctca

SEQ ID NO: 29566 - protein, 121 aa, Artificial Sequence
  Description of Artificial Sequence: Synthetic polypeptide
EVQLLESGGGLVQPGGSLRLSCAASGLTFSSYAMSWVRQDPGKGLEWVSAISGSGGNTFYGDSVKGRFTISRDNSKKTLYLQMNSLRAEDTAVYYCAKFFGIVGAGYFDYWGQGTLVTVSS

SEQ ID NO: 29567 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattaacgtttagtagctacgccatgagctgggtccgccaggatccagggaaggggctggagtgggtctcagctattagtggtagtggtggtaacacattctacggagactccgtgaagggccggttcaccatctccagagacaattccaagaaaacgctgtatctgcaaatgaacagcctgagagccgaggacacggccgtatattactgtgcgaaatttttcggtatagtgggagccgggttctttgactcctggggccagggaaccctggtcaccgtctcctca

SEQ ID NO: 29568 - protein, 121 aa, Artificial Sequence
  Description of Artificial Sequence: Synthetic polypeptide
EVQLLESGGGLVQPGGSLRLSCAASGLTFSSYAMSWVRQDPGKGLEWVSAISGSGGNTFYGDSVKGRFTISRDNSKKTLYLQMNSLRAEDTAVYYCAKFFGIVGAGFFDSWGQGTLVTVSS

SEQ ID NO: 29569 - DNA, 351 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtgactatggcatgcactgggtccgccaggctccaggcaaggggctggagtgggtggcagttatatggtatgctggaagtaataaataccatgtagactccgtgaagggccgattcaccatctccagagacaattccaagaacacgctgtatctgcaaatgaacagcctgagagccgaggacacggctgtgtattactgtgcgagggaactggggatgaggtctgactactggggccagggaaccctggtcaccgtctcctca

SEQ ID NO: 29570 - protein, 117 aa, Artificial Sequence
  Description of Artificial Sequence: Synthetic polypeptide
QVQLVESGGGVVQPGRSLRLSCVASGFTFSDYGMHWVRQAPGKGLEWVAVIWYAGSNKYHVDSVKGRFTISRDNSKNTLYLQMNSLRAEDTAVYYCARELGMRSDYWGQGTLVTVSS

SEQ ID NO: 29571 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtagcacaggctatgcacagaagttccagggcagagtcaccatgaccaggaacacctccataagcacagcctacatggagctgagcagcctgagatctgaggacacggccgtgtattactgtgcgtatagcagtggctggtactactttgactactggggccagggaaccctggtcaccgtctcctca

SEQ ID NO: 29572 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGSTGYAQKFQGRVTMTRNTSISTAYMELSSLRSEDTAVYYCAYSSGWYYFDYWGQGTLVTVSS

SEQ ID NO: 29573 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagaagctatgccatgagctgggtccgccaggctccagggaaggggctggagtgggtctcagctattagtggtagtggtggtaacacattctacgcagactccgtgaagggccggttcaccatctccagagacaattccaagaacacgctgtttcttcaaatgaacagcctgagagccgaggacacggccgtatattactgtgcgaaatttttcggtatagtgggagccgggtactttgactactggggccagggaaccctggtcaccgtctcctca

SEQ ID NO: 29574 - protein, 121 aa, Artificial Sequence
  Description of Artificial Sequence: Synthetic polypeptide
EVQLLESGGGLVQPGGSLRLSCAASGFTFRSYAMSWVRQAPGKGLEWVSAISGSGGNTFYADSVKGRFTISRDNSKNTLFLQMNSLRAEDTAVYYCAKFFGIVGAGYFDYWGQGTLVTVSS

SEQ ID NO: 29575 - DNA, 348 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgacatacactgggtccgccagtctccaggcaaggggctggagtgggtggcagttatatggtatgatggaagtaaaaaatattatgcagactccgtgaagggccgattcaccatctccagagacaattccaagaacacgttgtatctgcaaatgaacagcctgagagccgaggacacggctctgtattactgtgcgagagatcgggtcacttttgactactggggccagggaaccctggtcaccgtctcctca

SEQ ID NO: 29576 - protein, 116 aa, Artificial Sequence
  Description of Artificial Sequence: Synthetic polypeptide
QVQLVESGGGVVQPGRSLRLSCAASGFTFSDYDIHWVRQSPGKGLEWVAVIWYDGSKKYYADSVKGRFTISRDNSKNTLYLQMNSLRAEDTALYYCARDRVTFDYWGQGTLVTVSS

SEQ ID NO: 29577 - DNA, 363 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtaacacattctacgcagactccgtgaagggccggttcaccatctccagatacaattccaagaacacgctgtatctgcaaatgaacagcctgagagccgaggacacggccgtatattactgtgcgaaatttttcggtatggtgggagccggattctttgactactggggccagggaaccctggtcaccgtctcctca

SEQ ID NO: 29578 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGNTFYADSVKGRFTISRYNSKNTLYLQMNSLRAEDTAVYYCAKFFGMVGAGFFDYWGQGTLVTVSS

SEQ ID NO: 29579 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaataccatgcagactccgtgaagggccgattcaccatctccagagacaattccaagaacacgctgtatctgcaaatgaacagcctgagagccgaggacacggctgtgtattactgtgcgaggcggtatagcagcagctgggacgggggtatggacgtctggggccaagggaccacggtcaccgtctcctca

SEQ ID NO: 29580 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYHADSVKGRFTISRDNSKNTLYLQMNSLRAEDTAVYYCARRYSSSWDGGMDVWGQGTTVTVSS

SEQ ID NO: 29581 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgactcctaacagtggtaacacaggctatgcacagaagttccagggcagagtcaccatgaccaggaccacctccataagcacagcctacatggagctgagcagcctgagatctgaggacacggccgtgtattactgtgcgtttagcagtggctggtacttctttgactactggggccagggaaccctggtcaccgtctcctca

SEQ ID NO: 29582 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMTPNSGNTGYAQKFQGRVTMTRTTSISTAYMELSSLRSEDTAVYYCAFSSGWYFFDYWGQGTLVTVSS

SEQ ID NO: 29583 - DNA, 348 bp, Artificial Sequence
  Description of Artificial Sequence: Synthetic polynucleotide
caggtgcagttggtgcagtctggggctgaggtgaagaagcctggggcctcagtgaaggtctcctgcaaggcttctggatacaccttcgccggctactatatacactgggtgcgacaggcccctggacaaggacttgagtggttgggttggatcaaccctaacagtggtggcacaaactatgcacagaagtttcagggcagggtcaccatgaccagggacacgtccatcagcacagcctacatggagctgagcaggctgagatttgacgacacggccgtgtattactgtgcgagagatccggggccctttgactactggggccagggaaccctggtcaccgtctcctca

SEQ ID NO: 29584 - protein, 116 aa, Artificial Sequence
  Description of Artificial Sequence: Synthetic polypeptide
QVQLVQSGAEVKKPGASVKVSCKASGYTFAGYYIHWVRQAPGQGLEWLGWINPNSGGTNYAQKFQGRVTMTRDTSISTAYMELSRLRFDDTAVYYCARDPGPFDYWGQGTLVTVSS

SEQ ID NO: 29585 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagctattagtggtagtggtggtaacacattctacgcagactccgtgaagggccggttcaccatttccagagacaattccaagaacacgctgtatctgcaaatgaacagcctgagagccgaggacacggccgtatattactgtgcgaaaaggggggtctacggtgactacgaggcttttgatatctggggccaagggacaatggtcaccgtctcttca

SEQ ID NO: 29586 - protein, 121 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGNTFYADSVKGRFTISRDNSKNTLYLQMNSLRAEDTAVYYCAKRGVYGDYEAFDIWGQGTMVTVSS

SEQ ID NO: 29587 - DNA, 366 bp, Artificial Sequence
  Description of Artificial Sequence: Synthetic polynucleotide
caggtacaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggggtatagcagtggggtactacggtatggacgtctggggccaagggaccacggtcaccgtctcctca

SEQ ID NO: 29588 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARERGIAVGYYGMDVWGQGTTVTVSS

SEQ ID NO: 29589 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtagaagtagttactactggggctggatccgccagcccccagggaaggggctggagtggattgggaatatctattatagtgggagcacctactacaacccgtccctcaagagtcgagtcaccatatccgtagacacgtccaagaaccagttctccctgaagctgagctctgtgaccgccgcagacacggctctgtattactgtgcgagacatagcagcagctggtcccttgactactggggccagggaaccctggtcaccgtctcctca

SEQ ID NO: 29590 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYYNPSLKSRVTISVDTSKNQFSLKLSSVTAADTALYYCARHSSSWSLDYWGQGTLVTVSS

SEQ ID NO: 29591 - DNA, 375 bp, Artificial Sequence
  Description of Artificial Sequence: Synthetic polynucleotide
caggtgcaactagtgcagtctggggctgaggtgaagaagcctggggcctcagtgaaggtctcctgcaaggcttctggatacagtttcaccggccactatatacactgggtgcgacaggcccctggacaagggcttgagtacatgggatggatcaacccgaacagtggtggcacaaactatgtacagaaatttcagggcagggtcaccatgaccagggacacgtccatcagcacagcctacatggagctgagcaggctgagatctgacgacacggccatatattactgttcgagagggggcctactgggagctaccaactactactactacggtatggacgtctggggccaagggaccacggtcaccgtcacctca

SEQ ID NO: 29592 - protein, 125 aa, Artificial Sequence
  Description of Artificial Sequence: Synthetic polypeptide
QVQLVQSGAEVKKPGASVKVSCKASGYSFTGHYIHWVRQAPGQGLEYMGWINPNSGGTNYVQKFQGRVTMTRDTSISTAYMELSRLRSDDTAIYYCSRGGLLGATNYYYYGMDVWGQGTTVTVTS

SEQ ID NO: 29593 - DNA, 363 bp, Artificial Sequence
  Description of Artificial Sequence: Synthetic polynucleotide
gaggtgcagctggtggagtctgggggaggcttggtacagcctggggggtccctgagactctcctgtgcagcctctggattcactttcagtagctatagcatgaattgggtccgccaggctccagggaaggggctggggtgggtgtcatacattagtagtagtagtgggaccatatactacgcagactctgtgaagggccgattcaccatctccagagacaatgccaagaactcactgtatctgcaaatgaacagcctgagagacgaggacacggctgtgtattactgtgcgagagaatggggaatggcagtggctggcccgtttgactactggggccagggaaccctggtcaccgtctcctca

SEQ ID NO: 29594 - protein, 121 aa, Artificial Sequence
  Description of Artificial Sequence: Synthetic polypeptide
EVQLVESGGGLVQPGGSLRLSCAASGFTFSSYSMNWVRQAPGKGLGWVSYISSSSGTIYYADSVKGRFTISRDNAKNSLYLQMNSLRDEDTAVYYCAREWGMAVAGPFDYWGQGTLVTVSS

SEQ ID NO: 29595 - DNA, 375 bp, Artificial Sequence
  Description of Artificial Sequence: Synthetic polynucleotide
caggtgcagctggtgcagtctgggcctgaggtgaagaagcctggggcctcagtgaaggtctcctgcaaggcttctggatacatcttcaccggcaattatatacactgggtgcgacaggcccctggacaagggcttgagtacatgggatggatcaaccctaacagtggtggcacaaactatgtacagaagtttcagggcagggtcaccatgaccagggacacgtccatcagcacagccaacatggaactgaccagtctgagatctgacgacacggccgtgtattactgttcgagagggggcctactgggagctacctactactactactacggtatggacgtctggggccaagggaccacggtcaccgtctcctca

SEQ ID NO: 29596 - protein, 125 aa, Artificial Sequence
  Description of Artificial Sequence: Synthetic polypeptide
QVQLVQSGPEVKKPGASVKVSCKASGYIFTGNYIHWVRQAPGQGLEYMGWINPNSGGTNYVQKFQGRVTMTRDTSISTANMELTSLRSDDTAVYYCSRGGLLGATYYYYYGMDVWGQGTTVTVSS

SEQ ID NO: 29597 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcacaaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtataactgtgcggttagcagtggctggtactactttgactactggggccagggaaccctggtcaccgtctcctca

SEQ ID NO: 29598 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYNCAVSSGWYYFDYWGQGTLVTVSS

SEQ ID NO: 29599 - DNA, 357 bp, Artificial Sequence
  Description of Artificial Sequence: Synthetic polynucleotide
caggtgcagctggtggaatctgggggaggcgtggtccagcctgggaggtccctgagactctcctgtgcagcgtctggattcaccttcagcacctatggcatgcactgggtccgccaggctccaggcaaggggctggagtgggtggcagttatatggcatgatggaagtgataaatattatgtagactccgtgaagggccgattcaccatctccagagacaattccaagaacacgctgtatctgcaaatgaacagcctgagagccgaggacacggctgtgtattactgtgcgagagaagacccgcgtaccagctgctctgactactggggccagggaaccctggtcaccgtctcctca

SEQ ID NO: 29600 - protein, 119 aa, Artificial Sequence
  Description of Artificial Sequence: Synthetic polypeptide
QVQLVESGGGVVQPGRSLRLSCAASGFTFSTYGMHWVRQAPGKGLEWVAVIWHDGSDKYYVDSVKGRFTISRDNSKNTLYLQMNSLRAEDTAVYYCAREDPRTSCSDYWGQGTLVTVSS

SEQ ID NO: 29601 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctagaatgggtgacagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatagcctctcgggtatagcagcagcttttgactactggggccagggaaccctggtcaccgtctcctca

SEQ ID NO: 29602 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVTVIWYDGSNKYYADSVKGRFTISRDNSKNTLYLQMNSLRAEDTAVYYCARDSLSGIAAAFDYWGQGTLVTVSS

SEQ ID NO: 29603 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataacatgaactgggtccgccaggctccagggaaggggctggagtgggtctcatccattagtggtagtagcacttacatgaactacacagactcagtgaagggccgattcaccatctccagagacaacgccaagaactcactgtatctgcaaatgaacagcctgagagccgaggacacggctgtgtattactgtgcgagactacgtaattttgactactggggccagggaaccctggtcaccgtctcctca

SEQ ID NO: 29604 - protein, 115 aa, Artificial Sequence
  Description of Artificial Sequence: Synthetic polypeptide
EVQLVESGGGLVKPGGSLRLSCAASGFTFSSYNMNWVRQAPGKGLEWVSSISGSSTYMNYTDSVKGRFTISRDNAKNSLYLQMNSLRAEDTAVYYCARLRNFDYWGQGTLVTVSS

SEQ ID NO: 29605 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactttgcacagaagtttcagggcagggtcaccatgaccagggacgcgtccatcaacacagcctacatggagctgcgcagcctgatatctgacgacacggccgtatattactgtgcgagagctccgggtgtagcagcagctggttcatggggatactttgactactggggccagggaaccctggtcaccgtctcctca

SEQ ID NO: 29606 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNFAQKFQGRVTMTRDASINTAYMELRSLISDDTAVYYCARAPGVAAAGSWGYFDYWGQGTLVTVSS

SEQ ID NO: 29607 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggactgggtggcagtcatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatgatcccagatcctcggccggggactactggggccagggaaccctggtcaccgtctcctca

SEQ ID NO: 29608 - protein, 119 aa, Artificial Sequence
  Description of Artificial Sequence: Synthetic polypeptide
QVQLVESGGGVVQPGRSLRLSCAASGFTFSSYGMHWVRQAPGKGLDWVAVIWYDGSNKYYADSVKGRFTISRDNSKNTLYLQMNSLRAEDTAVYYCARDDPRSSAGDYWGQGTLVTVSS

SEQ ID NO: 29609 - DNA, 351 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagctatggcatgcactgggtccgccaggctccaggcaaggggctggagtgggtggcagttatatggtttgatgaaactaataaatactatggagactccgtgaagggccgattcaccatctccagagacaattccaagaacacgctgtatctgcaaatgaacagcctgagagccgaggacacggctgtgtattactgtgcgagagagcttgggttcagcagtgactattggggccagggaaccctggtcaccgtctcctca

SEQ ID NO: 29610 - protein, 117 aa, Artificial Sequence
  Description of Artificial Sequence: Synthetic polypeptide
QVQLVESGGGVVQPGRSLRLSCVASGFTFSSYGMHWVRQAPGKGLEWVAVIWFDETNKYYGDSVKGRFTISRDNSKNTLYLQMNSLRAEDTAVYYCARELGFSSDYWGQGTLVTVSS

SEQ ID NO: 29611 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagcgattatgtcatgcactgggtccgccaggctccaggcaaggggctggagtgggtggcagtcatatggtatgatggaagtaataaatactatgcagactccgtgaagggccgattcaccatctccagagacaattcccagaacacgctgtatctgcaaatgaatagcctgagagccgaggacacggctgtgtattactgtgcgagagaaaggtatagcagcagctggtacgactacggtatggacgtctggggccaagggaccacggtcaccgtctcctca

SEQ ID NO: 29612 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVAVIWYDGSNKYYADSVKGRFTISRDNSQNTLYLQMNSLRAEDTAVYYCARERYSSSWYDYGMDVWGQGTTVTVSS

SEQ ID NO: 29613 - DNA, 348 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttacttctggagctggatccggcagcccgccgggaagggactggagtggattgggcgtatctataccagtgggatctccaactacaatccctccctcaagagtcgagtcaccatgtcagttgacacgtccaagaaccagttctccctgaagctgagctctgtgaccgccgcggacacggccgtgtattactgtgcgaggtttagcagtggcttttttgactactggggccagggtaccctggtcaccgtctcctca

SEQ ID NO: 29614 - protein, 116 aa, Artificial Sequence
  Description of Artificial Sequence: Synthetic polypeptide
QVQLQESGPGLVKPSETLSLTCTVSGGSISSYFWSWIRQPAGKGLEWIGRIYTSGISNYNPSLKSRVTMSVDTSKNQFSLKLSSVTAADTAVYYCARFSSGFFDYWGQGTLVTVSS

SEQ ID NO: 29615 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatgcactgggtccgccaggctccaggcaaggggctggagtgggtggcagttatatggtatgatggaagtaataaatactatgcagactccatgaagggccgattcaccatctccagagacaattccaagaacacgctgtatctgcaaatgaacagcctgagagccgaggacacggctgtgtattactgtgcgagagaacggtatagcagtggctggtacgactacggtatggacgtctggggccaagggaccacggtcaccgtctcctca

SEQ ID NO: 29616 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVAVIWYDGSNKYYADSMKGRFTISRDNSKNTLYLQMNSLRAEDTAVYYCARERYSSGWYDYGMDVWGQGTTVTVSS

SEQ ID NO: 29617 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcaattatatggtatgatggaagtaataaatactatgcagactccgtgaagggccgattcaccatctccagagacaattccaagaacacgctatatctacaaatgaacagcctgagagccgaggacacggctgtgtattactgtgcgagagatacatacgatttttggagtggttatttgggctactggggccagggaaccctggtcaccgtctcctca

SEQ ID NO: 29618 - protein, 121 aa, Artificial Sequence
  Description of Artificial Sequence: Synthetic polypeptide
QVQLVESGGGVVQPGRSLRLSCAASGFTFSTYGMHWVRQAPGKGLEWVAIIWYDGSNKYYADSVKGRFTISRDNSKNTLYLQMNSLRAEDTAVYYCARDTYDFWSGYLGYWGQGTLVTVSS

SEQ ID NO: 29619 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaaccaaacagtggtggcacaaaccaagcacagaagtttcagggcagggtcaccatgaccagggacacgtccatcagcacagcctacatggagctgagcgggctgagatctgacgacacggccgtgtattactgtgcgagagctccgggtactgcagcaactggtacatggggatactttgactactggggccagggaaccctggtcaccgtctcctca

SEQ ID NO: 29620 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWIKPNSGGTNQAQKFQGRVTMTRDTSISTAYMELSGLRSDDTAVYYCARAPGTAATGTWGYFDYWGQGTLVTVSS

SEQ ID NO: 29621 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaagtaataaatactatgtagactccgtgaagggccgattcaccatctccagagacaattccaagaacacgctgtatctgcaaatgaacagcctgagagccgaggacacggctgtgtattactgtgcgagggaactcgggttcctctctgaccactggggccagggaaccctggtcaccgtctcctca

SEQ ID NO: 29622 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDESNKYYVDSVKGRFTISRDNSKNTLYLQMNSLRAEDTAVYYCARELGFLSDHWGQGTLVTVSS

SEQ ID NO: 29623 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtgtctccatcagcagaagtagttactactggggctggatccgccagcccccagggaaggggctggagtggattgggagtatctattacagtgggagcacctcctacaacccgtccctcaagagtcgagtcaccatatccgtagacacgtccaagaaccagttctccctgaagctgagctctgtgaccgccgcagacacggctgtgtattattgtgcgagactggacagtggctggtcctttgactactggggccagggaaccctggtcaccgtctcctca

SEQ ID NO: 29624 - protein, 119 aa, Artificial Sequence
  Description of Artificial Sequence: Synthetic polypeptide
QLQLQESGPGLVKPSETLSLTCTVSGVSISRSSYYWGWIRQPPGKGLEWIGSIYYSGSTSYNPSLKSRVTISVDTSKNQFSLKLSSVTAADTAVYYCARLDSGWSFDYWGQGTLVTVSS

SEQ ID NO: 29625 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagtaatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccttatattactgtgcgaaaaggaactacgacgatgcttttgatatctggggccaagggacaatggtcaccgtctcttca

SEQ ID NO: 29626 - protein, 118 aa, Artificial Sequence
  Description of Artificial Sequence: Synthetic polypeptide
EVQLLESGGGLVQPGGSLRLSCAASGFTFSSNAMSWVRQAPGKGLEWVSVISGSGGSTYYADSVKGRFTISRDNSKNTLYLQMNSLRAEDTALYYCAKRNYDDAFDIWGQGTMVTVSS

SEQ ID NO: 29627 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagtgatatggtttgagggaagtaataaacactatacagactccgtgaagggccgattcaccatctccagagacaattccaagaacacgctgtatctgcaaatgaacagcctgagagccgaggacacggctgtgtattactgtgcgagagaacttgggttcagcagtgactactggggccagggaaccctggtcaccgtctcctca

SEQ ID NO: 29628 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWFEGSNKHYTDSVKGRFTISRDNSKNTLYLQMNSLRAEDTAVYYCARELGFSSDYWGQGTLVTVSS

SEQ ID NO: 29629 - DNA, 372 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacagtggtggcacaaactctgcacagaagtttcagggcagggtcaccatgaccagggacacgtccatcagcacagcctacatggagctgagcaggctgagatctgacgacacggccgtatattactgtgcgagagctccgggtaaagcagcagctggtacatggggatactttgactactggggccagggaaccctggtcaccgtctcctca

SEQ ID NO: 29630 - protein, 124 aa, Artificial Sequence
  Description of Artificial Sequence: Synthetic polypeptide
QVQLVQSGAEVKKPGASVKVSCKASGYTFTGYYIHWVRQAPGQGLEWMGWINPNSGGTNSAQKFQGRVTMTRDTSISTAYMELSRLRSDDTAVYYCARAPGKAAAGTWGYFDYWGQGTLVTVSS

SEQ ID NO: 29631 - DNA, 354 bp, Artificial Sequence
  Description of Artificial Sequence: Synthetic polynucleotide
caggttcagctggtgcagtctggagctgaggtgaagaagcctggggcctcagtgaaggtctcctgcaaggcttctggttacacctttcccagctatggtatcagttgggtgcgacaggcccctggacaaggacttgagtggatgggatggatcagcgcttacagtggtaacacaaactatgcacagaagctccagggcagagtcaccatgaccacagacacatccacgagcacagcctacatggagctgaggagcctgagatctgacgacacggccgtgtatttctgtgcgagaggggaagcagtggctgtcttcgacccctggggccagggaaccctggtcaccgtctcctca

SEQ ID NO: 29632 - protein, 118 aa, Artificial Sequence
  Description of Artificial Sequence: Synthetic polypeptide
QVQLVQSGAEVKKPGASVKVSCKASGYTFPSYGISWVRQAPGQGLEWMGWISAYSGNTNYAQKLQGRVTMTTDTSTSTAYMELRSLRSDDTAVYFCARGEAVAVFDPWGQGTLVTVSS

SEQ ID NO: 29633 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatggaagtaataaatactatggagactccgtgaagggccgattcaccatctccagagacaattccaagaacacgctgtatctgcaaatgaacagcctgagagccgaggacacggctgtgtattactgtgcgagagatcagggcatagtgggagctacttggtttgactactggggccagggaaccctggtcaccgtctcctca

SEQ ID NO: 29634 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAVIWYDGSNKYYGDSVKGRFTISRDNSKNTLYLQMNSLRAEDTAVYYCARDQGIVGATWFDYWGQGTLVTVSS

SEQ ID NO: 29635 - DNA, 339 bp, Artificial Sequence
  Description of Artificial Sequence: Synthetic polynucleotide
gaggtgcagctggtggagtctgggggaggcctggtcaagccgggggggtccctgagactctcctgtgcagcctctggattcaccttcagtagctataggatgaactgggtccgccaggctccagggaaggggctggagtgggtctcatccattagtagtagtaatagttccatatactacgcagactcagtgaagggccgattcaccacctccagagacaacgccaagaactcactgtatctgcaaatgaacagcctgagagccgaggacacggctgtgtattactgtacgagtacaagtgggagctggggccagggaaccctggtcaccgtctcctca

SEQ ID NO: 29636 - protein, 113 aa, Artificial Sequence
  Description of Artificial Sequence: Synthetic polypeptide
EVQLVESGGGLVKPGGSLRLSCAASGFTFSSYRMNWVRQAPGKGLEWVSSISSSNSSIYYADSVKGRFTTSRDNAKNSLYLQMNSLRAEDTAVYYCTSTSGSWGQGTLVTVSS

SEQ ID NO: 29637 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaacaatgcacagaagtttcagggcagggtcaccatgaccagggccacgtccatcagcacagcctacatggaactgagcaggctgagatctgacgacacggccgtgtattattgtgcgagagctccgggtacagcagcagctggtacatggggatactttgactactggggccagggaaccctggtcaccgtctcctca

SEQ ID NO: 29638 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNNAQKFQGRVTMTRATSISTAYMELSRLRSDDTAVYYCARAPGTAAAGTWGYFDYWGQGTLVTVSS

SEQ ID NO: 29639 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaaccaaacagtggtggcacaaaccaagcacagaagttccagggcagggtcaccatgaccagggacacgtccatcagcacaggttacatggagctgagcaggctgagatctgacgacacggccgtgtattactgtgcgagagctccgggcacagtagcagctggtacatggggatactttgactattggggccagggaaccctggtcaccgtctcctca

SEQ ID NO: 29640 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWIKPNSGGTNQAQKFQGRVTMTRDTSISTGYMELSRLRSDDTAVYYCARAPGTVAAGTWGYFDYWGQGTLVTVSS

SEQ ID NO: 29641 - DNA, 351 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtgactatggcatgcactgggtccgccaggctccaggcaaggggctggagtgggtggcagttatatggtttgagggaagtcataaatactatacagactccgtgaagggccgattcaccatctccagagacaattccaagaacacgctgtatctgcaaatgaacagcctgagagccgaggacacggctgtgtattactgtgcgagagaacttgggttcagcagtgactactggggccagggaaccctggtcaccgtctcctca

SEQ ID NO: 29642 - protein, 117 aa, Artificial Sequence
  Description of Artificial Sequence: Synthetic polypeptide
QVQLVESGGGVVQPGRSLRLSCVASGFTFSDYGMHWVRQAPGKGLEWVAVIWFEGSHKYYTDSVKGRFTISRDNSKNTLYLQMNSLRAEDTAVYYCARELGFSSDYWGQGTLVTVSS

SEQ ID NO: 29643 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggcatgatggaagtgataaatactatgcagactccgtgaagggccgattcaccatctccagagacaattccaagaacacgctgtatctgcaaatgaacagcctgagagccgaggacacggctgtgtattactgtgcgagagaagacccgcgtaccagttgttctgactactggggccagggaaccctggtcaccgtctcctca

SEQ ID NO: 29644 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWHDGSDKYYADSVKGRFTISRDNSKNTLYLQMNSLRAEDTAVYYCAREDPRTSCSDYWGQGTLVTVSS

SEQ ID NO: 29645 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaagggactggagtgggtctcatccattagtggtactagtagttacatatactacgcagactcagtgaagggccgattcaccatctccagagacaacgccaagaactcactgtatctgcaaatgaacggcctgagagccgaggacacggctgtgtatttctgtgcgagaaccaatgcttttgatatctggggccaggggacaatggtcaccgtctcttca

SEQ ID NO: 29646 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGTSSYIYYADSVKGRFTISRDNAKNSLYLQMNGLRAEDTAVYFCARTNAFDIWGQGTMVTVSS

SEQ ID NO: 29647 - DNA, 360 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgttatgagctgggtccgccaggctccagggaaggggctggagtgggtctcaggtattagtggtagtggtgctagaacatactacgcagactccgtgaagggccgattcaccatctccagagacaattccaagaacacgctgtatctgcaaatgaacagcctgagagccgaggacacggccgtatattactgtgcggaactggggatagactactactacggtatggacgtctggggccaagggaccacggtcaccgtctcctca

SEQ ID NO: 29648 - protein, 120 aa, Artificial Sequence
  Description of Artificial Sequence: Synthetic polypeptide
EVQLLESGGGLVQPGGSLRLSCAASGFTFSSYVMSWVRQAPGKGLEWVSGISGSGARTYYADSVKGRFTISRDNSKNTLYLQMNSLRAEDTAVYYCAELGIDYYYGMDVWGQGTTVTVSS

SEQ ID NO: 29649 - DNA, 369 bp, Artificial Sequence
  Description of Artificial Sequence: Synthetic polynucleotide
caggtgcagctggtggagtctgggggaggcgtggtccagcctgggaggtccctgagactctcctgtggagcgtctggattcaccttcagtagttatggcatgcactgggtccgccaggctccaggcaaggggctggagtgggtggcagttatatggtatgatggaagtaataaatactatgcagactccgtgaagggccgattcaccatctccagagacaattccaagaacacgctgtctctgcaaatgaacagcctgagagccgaggacacggctctgtattactgtgcgagagagatgtatagcagcaactggtacgactacggtttggacgtctggggccaagggaccacggtcaccgtctcctca

SEQ ID NO: 29650 - protein, 123 aa, Artificial Sequence
  Description of Artificial Sequence: Synthetic polypeptide
QVQLVESGGGVVQPGRSLRLSCGASGFTFSSYGMHWVRQAPGKGLEWVAVIWYDGSNKYYADSVKGRFTISRDNSKNTLSLQMNSLRAEDTALYYCAREMYSSNWYDYGLDVWGQGTTVTVSS

SEQ ID NO: 29651 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcactgggtccgacaggcccctggacaagggcttgagtggatgggatggatcaaccctaacaatggtggcacacactatgcacagaagtttcaggactgggtcaccatgaccagggacacgtccatcagcacagcctatatggaactgagcaggctgagatctgacgacacggccgtgtattactgtgcgagagatagtagaagttcgtgggactactggggccagggaaccctggtctccgtctcctca

SEQ ID NO: 29652 - protein, 117 aa, Artificial Sequence
  Description of Artificial Sequence: Synthetic polypeptide
QVQLVQSGAEVKKPGASVKVSCKASGYTFTGYHMHWVRQAPGQGLEWMGWINPNNGGTHYAQKFQDWVTMTRDTSISTAYMELSRLRSDDTAVYYCARDSRSSWDYWGQGTLVSVSS

SEQ ID NO: 29653 - DNA, 363 bp, Artificial Sequence
  Description of Artificial Sequence: Synthetic polynucleotide
caggtgcagctggtggagtcggggggaggcgtggtccagcctgggaggtccctgagactctcctgtgcagcgtctggattcaccttcagtagttatggcatgcactgggtccgccaggctccaggcaaggggctggagtgggtggcagctatatggtatgatggaagtaataaatattatggagactccgtgaagggccgagtcaccatctccagagacaattccaagaactcgctgcatctgcaaatgaacagcctgagagccgaggacacggctgtgtattactgtgcgagagatcagggcatagtgggagctacttggtttgactactggggccagggaaccctggtcaccgtctcctca

SEQ ID NO: 29654 - protein, 121 aa, Artificial Sequence; identical to SEQ ID NO: 29532
  Description of Artificial Sequence: Synthetic polypeptide

SEQ ID NO: 29655 - DNA, 372 bp, Artificial Sequence; identical to SEQ ID NO: 29619
  Description of Artificial Sequence: Synthetic polynucleotide

SEQ ID NO: 29656 - protein, 124 aa, Artificial Sequence; identical to SEQ ID NO: 29620
  Description of Artificial Sequence: Synthetic polypeptide

SEQ ID NO: 29657 - DNA, 348 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtaactatggcatgcactgggtccgccaggctccaggcaaggggctggaatgggtggcagttatattatatgatggaagtaagaaatactatgcagactccgtgaagggccgattcaccatctccagagacaattccaagaacacgctttatctgcaaatgaacagcctgagagctgaggacacggctgtgtattactgtgcgaggagtatcccggaatttgactattggggccagggaaccctggtcaccgtctcctca

SEQ ID NO: 29658 - protein, 116 aa, Artificial Sequence
  Description of Artificial Sequence: Synthetic polypeptide
QVQLVESGGGVVQPGRSLRLSCAASGFTFSNYGMHWVRQAPGKGLEWVAVILYDGSKKYYADSVKGRFTISRDNSKNTLYLQMNSLRAEDTAVYYCARSIPEFDYWGQGTLVTVSS

SEQ ID NO: 29659 - DNA, 351 bp, Artificial Sequence
  Description of Artificial Sequence: Synthetic polynucleotide
gaggtgcagctggtggagtctgggggaggcctggtcaagccgggggggtccctgagactctcctgtgcagcctctggattcaccttaagtagctttggcatgaactgggtccgccaggctccagggaaggggctggagtgggtctcatacattagtagaagtagtagtcacatatactacgcagactcagtgaagggccgattcaccatctccagagacaacgccaagaactcactgtatctgcaaatgaacagcctgagagccgaggacacggctgtgtattactgtgcggtctctagtgggagcccctttgactactggggccagggaaccctggtcaccgtctcctca

SEQ ID NO: 29660 - protein, 117 aa, Artificial Sequence
  Description of Artificial Sequence: Synthetic polypeptide
EVQLVESGGGLVKPGGSLRLSCAASGFTLSSFGMNWVRQAPGKGLEWVSYISRSSSHIYYADSVKGRFTISRDNAKNSLYLQMNSLRAEDTAVYYCAVSSGSPFDYWGQGTLVTVSS

SEQ ID NO: 29661 - DNA, 345 bp, Artificial Sequence
  Description of Artificial Sequence: Synthetic polynucleotide
gaggtgcagttggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatatattacgcagactcagtgatgggccgattcaccatctccagagacaacgccaagaactctctgtatctgcaaatgaacagcctgagagccgaggacacggctgtgtattactgtgcgagagtcaacagctttgactcctggggccagggaaccctggtcaccgtctcctca

SEQ ID NO: 29662 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVMGRFTISRDNAKNSLYLQMNSLRAEDTAVYYCARVNSFDSWGQGTLVTVSS

SEQ ID NO: 29663 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggctgttatatggtatgatgtaagtaataaatactatgcagactccgtgaagggccgattcaccatctccagagacaattccaagaacacgctgtatcttcaaatgaacagcctgagagccgaggacacggctgtgtattactgtgtgagagaactggggatgacctctgactgctggggccagggaaccctggtcaccgtctcctca

SEQ ID NO: 29664 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDVSNKYYADSVKGRFTISRDNSKNTLYLQMNSLRAEDTAVYYCVRELGMTSDCWGQGTLVTVSS

SEQ ID NO: 29665 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaaggggctggagtggattgggaatatctattatagtgggagcacctattacatcccgtccctcaagagtcgagtcaccatatccgtagacacgtccaagaaccagttctccctgaagctgacctctgtgaccgccgcagacacggctgtgtattactgtgcgagacatagcaccagctggtccattgactactggggccagggaaccctggtcaccgtctcctca

SEQ ID NO: 29666 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGNIYYSGSTYYIPSLKSRVTISVDTSKNQFSLKLTSVTAADTAVYYCARHSTSWSIDYWGQGTLVTVSS

SEQ ID NO: 29667 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgccatgcactgggtccgccaggctccaggcaaggggctggagtgggtggcagttatatggtatgatggaagtgataaatactatgcagactccgtgaagggccgattcaccatctccagagacaattccaagaacacgctgtatctgcaaatgatcagcctgagagccgaggacacggctgtttattactgtgcgagagatatccctagcaactcggcgggggactactggggccagggaaccctggtcaccgtctcctca

SEQ ID NO: 29668 - protein, 119 aa, Artificial Sequence
  Description of Artificial Sequence: Synthetic polypeptide
QVQLVESGGGVVQPGRSLRLSCAASGFTFSNYAMHWVRQAPGKGLEWVAVIWYDGSDKYYADSVKGRFTISRDNSKNTLYLQMISLRAEDTAVYYCARDIPSNSAGDYWGQGTLVTVSS

SEQ ID NO: 29669 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgtaaggcttctggatacaccttcaccggctaccatatgcactgggtgcgacaggcccctggacaagggcttgagtggatgggatggatcaaccctaacagtaatgccacaaactatgcacagaagtttcagggcagggtcaccatgaccagggacacgtccatcagcacagcctacatggaactgagcaggctgagatctgacgacacggccgtgtattactgtgcgagagatagcatatcgtcgtgggactactggggccagggaaccctggtcaccgtctcctca

SEQ ID NO: 29670 - protein, 117 aa, Artificial Sequence
  Description of Artificial Sequence: Synthetic polypeptide
QVQLVQSGAEVKKPGASVKVSCKASGYTFTGYHMHWVRQAPGQGLEWMGWINPNSNATNYAQKFQGRVTMTRDTSISTAYMELSRLRSDDTAVYYCARDSISSWDYWGQGTLVTVSS

SEQ ID NO: 29671 - DNA, 363 bp, Artificial Sequence
  Description of Artificial Sequence: Synthetic polynucleotide
caggttcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaactcgctgtatctgcaaatgaacagcctgagcgccgaggacacggctgtttattactgtgcgagagatcagggcatagtgggagctacttggtttgactactggggccagggaaccctggtcaccgtctcctca

SEQ ID NO: 29672 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNSLYLQMNSLSAEDTAVYYCARDQGIVGATWFDYWGQGTLVTVSS

SEQ ID NO: 29673 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcctctggatacatcttcaccggctactatatgcactgggtgcgacaggcccctggacaagggcttgagtggatgggatggatcaaccctaagagtggtggcacaaactctgcacagaagtttcagggcagggtctccatgaccagggacacgtccatcggcacagcctacatggagctgcgcgggctaagatctgacgacacggccgagtattactgtgcgagagctccgggtaaagcagcagctggtacatggggattctttgactactggggccagggaaccctggtcaccgtctcctca

SEQ ID NO: 29674 - protein, 124 aa, Artificial Sequence
  Description of Artificial Sequence: Synthetic polypeptide
QVQLVQSGAEVKKPGASVKVSCKASGYIFTGYYMHWVRQAPGQGLEWMGWINPKSGGTNSAQKFQGRVSMTRDTSIGTAYMELRGLRSDDTAEYYCARAPGKAAAGTWGFFDYWGQGTLVTVSS

SEQ ID NO: 29675 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccagactccaggcaaggggctggactgggtggcagttatatggcatgatggaagtaataaatactatgcagactccgtgaagggccgattcaccatctccagagacaattccaagaacacgctgtatctgcaaatgaacagcctgagagccgaggacacggctgtgtattactgtgcgagagatgatcccagatcctcggccggggactactggggccagggaaccctggtcaccgtctcctca

SEQ ID NO: 29676 - protein, 119 aa, Artificial Sequence
  Description of Artificial Sequence: Synthetic polypeptide
QVQLVESGGGVVQPGRSLRLSCAASGFTFSSYGMHWVRQTPGKGLDWVAVIWHDGSNKYYADSVKGRFTISRDNSKNTLYLQMNSLRAEDTAVYYCARDDPRSSAGDYWGQGTLVTVSS

SEQ ID NO: 29677 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatggggtggatgcaccctaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtacgtctttgactactggggccagggaaccctggtcaccgtctcctca

SEQ ID NO: 29678 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYVFDYWGQGTLVTVSS

SEQ ID NO: 29679 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgctctgggtccgccaggctccaggcaagggtctggagtgggtggcaattatatggtatgatgaaagtaataaatactatgcagactccgtgaagggccgattcaccatctccagagacaattccaagaacacgctgtatctgcaaatgaacagcctgagagccgaggacacggctgtgtattactgtgcgagagacctactggacccacgggactactggggccagggaaccctggtcaccgtctcctca

SEQ ID NO: 29680 - protein, 117 aa, Artificial Sequence
  Description of Artificial Sequence: Synthetic polypeptide
QVQLVESGGGVVQPGRSLRLSCAASGFTFSSYGMLWVRQAPGKGLEWVAIIWYDESNKYYADSVKGRFTISRDNSKNTLYLQMNSLRAEDTAVYYCARDLLDPRDYWGQGTLVTVSS

SEQ ID NO: 29681 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaaggacttgagtggatgggatggatcaaacctaacagtggtggcacaaaccaagcacagaagtttcagggcagggtcaccatgaccagggacacgtccatcagcacagcctacatggagctgagcagtctgagatctgacgacacggccgtgtattactgtgcgagagctccgggtatagcagcagctggtacatggggatactttgactactggggccagggaaccctggtcaccgtctcctca

SEQ ID NO: 29682 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWIKPNSGGTNQAQKFQGRVTMTRDTSISTAYMELSSLRSDDTAVYYCARAPGIAAAGTWGYFDYWGQGTLVTVSS

SEQ ID NO: 29683 - DNA, 372 bp, Artificial Sequence; identical to SEQ ID NO: 29619
  Description of Artificial Sequence: Synthetic polynucleotide

SEQ ID NO: 29684 - protein, 124 aa, Artificial Sequence; identical to SEQ ID NO: 29620
  Description of Artificial Sequence: Synthetic polypeptide

SEQ ID NO: 29685 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcttccattagtggtaatagtacttacatatactacacagactcagtgaagggccgattcaccatctccagagacaacgccaagaactcactgtatctgcaaatggacagcctgacagccgaggacacggctgtgtattactgtgcgagagtggccgcctttgactgctggggccagggaaccctggtcaccgtctcctca

SEQ ID NO: 29686 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGNSTYIYYTDSVKGRFTISRDNAKNSLYLQMDSLTAEDTAVYYCARVAAFDCWGQGTLVTVSS

SEQ ID NO: 29687 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcaacgtctggattcaccttcagtgactatggcatgcactgggtccgccaggctccaggcaaggggctggagtgggtggcagtgatatggtatgatgaaagtaataaatactatgcagactccgtgaagggccgattcaccatctccagagacaattccaagaacacgctgtatctgcaaatgaacagcctgagagccgaggacacggctgtgtattactgtgcgagagaattggggtggcaggatgattactggggccagggaaccctggtcaccgtctcctca

SEQ ID NO: 29688 - protein, 117 aa, Artificial Sequence
  Description of Artificial Sequence: Synthetic polypeptide
QVQLVESGGGVVQPGRSLRLSCATSGFTFSDYGMHWVRQAPGKGLEWVAVIWYDESNKYYADSVKGRFTISRDNSKNTLYLQMNSLRAEDTAVYYCARELGWQDDYWGQGTLVTVSS

SEQ ID NO: 29689 - DNA, 354 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtagcacaggctatgcacagaagttccagggcagagtcaccatgaccagggacacctccgtcagcacagcctacatggagctgagcagcctgagatctgaggacacggccgtctattactgtgcatatagcagtggctggtactactttgactactggggccagggaaccctggtcaccgtctcctca

SEQ ID NO: 29690 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGSTGYAQKFQGRVTMTRDTSVSTAYMELSSLRSEDTAVYYCAYSSGWYYFDYWGQGTLVTVSS

SEQ ID NO: 29691 - DNA, 351 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtaactatggcatgcactgggtccgccaggccccaggcaaggggctggagtgggtggcagttatttggtatgatagaacaaataaatactatgcagactccgtgaagggccgattcaccatctccagagacaattccaagaacacgctgcatctgcaaatgaacagcctgagagccgaggacacggctgtgtattactgtgcgagagaactggggatgttgtctgactactggggccagggaaccctggtcaccgtctcctca

SEQ ID NO: 29692 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDRTNKYYADSVKGRFTISRDNSKNTLHLQMNSLRAEDTAVYYCARELGMLSDYWGQGTLVTVSS

SEQ ID NO: 29693 - DNA, 345 bp, Artificial Sequence
  Description of Artificial Sequence: Synthetic polynucleotide
gaggtgcagctggtggagtctgggggaggcctggtcaagcctggggggtccctgagactgtcctgtgcagcctctggattcaccttcagtagctatagcatgaactgggtccgccaggctccagggaagggactggagtgggtctcatccattagtggtactagtagttacatatactacgcagactcagtgaagggccgattcaccatctccagagacaacgccaagaactcactgtatctgcaaatgaacggcctgagagccgaggacacggctgtgtatttctgtgcgaaaaccaatgcttttgatatctggggccaggggacaatggtcaccgtctcttca

SEQ ID NO: 29694 - protein, 115 aa, Artificial Sequence
  Description of Artificial Sequence: Synthetic polypeptide
EVQLVESGGGLVKPGGSLRLSCAASGFTFSSYSMNWVRQAPGKGLEWVSSISGTSSYIYYADSVKGRFTISRDNAKNSLYLQMNGLRAEDTAVYFCAKTNAFDIWGQGTMVTVSS

SEQ ID NO: 29695 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacatcttcaccggctactatatgcactgggtgcgacaggcccctggacaagggcttgagtggatgggatggatcaaccctaacagtggtggcacaaactctgcacagaagtttcagggcagggtcaccatgaccagggacacgtccatcggcacagcctacatggagctgagcgggctgagatctgacgacacggccgtgtattactgtgcgagagctccgggtaaagcagcagctggtacatggggattctttgactactggggccagggaaccctggtcaccgtctcctca

SEQ ID NO: 29696 - protein, 124 aa, Artificial Sequence
  Description of Artificial Sequence: Synthetic polypeptide
QVQLVQSGAEVKKPGASVKVSCKASGYIFTGYYMHWVRQAPGQGLEWMGWINPNSGGTNSAQKFQGRVTMTRDTSIGTAYMELSGLRSDDTAVYYCARAPGKAAAGTWGFFDYWGQGTLVTVSS

SEQ ID NO: 29697 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatagaaataataaatactatggagactccgtgaagggccgattcaccatctccagagacaattccaagaacacgctgtatctgcaaatgaacagcctgagagccgaggacacggctgtgtattactgtgcgagagaactggggatgttgtctgactactggggccagggaaccctggtcaccgtctcctca

SEQ ID NO: 29698 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDRNNKYYGDSVKGRFTISRDNSKNTLYLQMNSLRAEDTAVYYCARELGMLSDYWGQGTLVTVSS

SEQ ID NO: 29699 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgatctgggtccgccaggctccagggaaggggctggagtgggtctcaactattagtggtagtggtggttacacatactccgcagactccgtgaagggccggttcaccatctccagagacaattccaagaacacgctgtatcttcaaatgaacagcctgagagccgaggacacggccgtatattactgtgcgagacgtatagcagtgactgggacggaatggtacgacccctggggccagggaaccctggtcaccgtctcctca

SEQ ID NO: 29700 - protein, 121 aa, Artificial Sequence
  Description of Artificial Sequence: Synthetic polypeptide
EVQLLESGGGLVQPGGSLRLSCAASGFTFSSYAMIWVRQAPGKGLEWVSTISGSGGYTYSADSVKGRFTISRDNSKNTLYLQMNSLRAEDTAVYYCARRIAVTGTEWYDPWGQGTLVTVSS

SEQ ID NO: 29701 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccagacacggggctggagtgggtggcagttatatggtttgatgaaagtaataaatactatgcagactccgtgaagggccgattcaccatctccagagacaattccaagaacacgctgtatctgcaaatgaacagcctgagagccgaggacacggctgtgtattactgtgcgagagagcttggtttcagcagtgactactggggccagggaaccctggtcaccgtctcctca

SEQ ID NO: 29702 - protein, 117 aa, Artificial Sequence
  Description of Artificial Sequence: Synthetic polypeptide
QVQLVESGGGVVQPGRSLRLSCAASGFTFSSYGMHWVRQAPDTGLEWVAVIWFDESNKYYADSVKGRFTISRDNSKNTLYLQMNSLRAEDTAVYYCARELGFSSDYWGQGTLVTVSS

SEQ ID NO: 29703 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaaaagtggtggcacaaattatgtacagaagtttcagggcagggtcaccatgaccagggacacgtccatcagcacagcctacatggagctgagcagtctgagatctgacgacacggccgtgtattactgtgcgagagctccgggtacagcaccagctgggtcatggggatactttgactactggggccagggaaccctggtcaccgtctcctca

SEQ ID NO: 29704 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPKSGGTNYVQKFQGRVTMTRDTSISTAYMELSSLRSDDTAVYYCARAPGTAPAGSWGYFDYWGQGTLVTVSS

SEQ ID NO: 29705 - DNA, 372 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctactatatgcactgggtacgacaggcccctggacaaggacttgactggatgggatggatcaaccctaaaagtggtggcacgaatcatgtccagaagtttcagggcagggtcgccatgaccagggacacgtccatcagcacagcctacatggagctgagcagtctgagatctgacgacacggccgtgtattactgtgcgagagctccgggtacagcagcagctgggtcatggggatgctttgactactggggccagggaaccctggtcaccgtctcctca

SEQ ID NO: 29706 - protein, 124 aa, Artificial Sequence
  Description of Artificial Sequence: Synthetic polypeptide
QVQLVQSGAEVKKPGASVKVSCKASGYTFTGYYMHWVRQAPGQGLDWMGWINPKSGGTNHVQKFQGRVAMTRDTSISTAYMELSSLRSDDTAVYYCARAPGTAAAGSWGCFDYWGQGTLVTVSS

SEQ ID NO: 29707 - DNA, 348 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcagttatattatatgatggaagtaagaaatactatgcagcctccgtgaagggccgattcaccatctccagagacaattccaagaacacgctgtatctgcaaatgaacagcctgagagctgaggacacggctgtgtattactgtgcgaggagtatcccggactttgactactggggccagggaaccctggtcaccgtctcctca

SEQ ID NO: 29708 - protein, 116 aa, Artificial Sequence
  Description of Artificial Sequence: Synthetic polypeptide
QVQLVESGGGVVQPGRSLRLSCAASGFTFSYYGMHWVRQAPGKGLEWVAVILYDGSKKYYAASVKGRFTISRDNSKNTLYLQMNSLRAEDTAVYYCARSIPDFDYWGQGTLVTVSS

SEQ ID NO: 29709 - DNA, 369 bp, Artificial Sequence
  Description of Artificial Sequence: Synthetic polynucleotide
gaggtgcagttactggagtctgggggaggctgggtacagtctggggggtccctgagactctcctgtgcagcctctggattcacctttagcagcaatgccatgagctgggtccgccaggctccagggaaggggctggagtgggtctcagacattagtcgtagtggtggtaccacattctacgcagactccgtgaagggccggttcaccatctccagagacaattccaagaacacgctgtatctgcaaatgaacagcctgagagccgaggacacggccgtatattactgtgcgaaatgggatagcagcagctggtacgacgtgactccctttgactactggggccagggaaccctggtcaccgtctcctca

SEQ ID NO: 29710 - protein, 123 aa, Artificial Sequence
  Description of Artificial Sequence: Synthetic polypeptide
EVQLLESGGGWVQSGGSLRLSCAASGFTFSSNAMSWVRQAPGKGLEWVSDISRSGGTTFYADSVKGRFTISRDNSKNTLYLQMNSLRAEDTAVYYCAKWDSSSWYDVTPFDYWGQGTLVTVSS

SEQ ID NO: 29711 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagcaattatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtatattactgtgcgagagaaaggtatagcagcagctggttcgactacggtatggacgtctggggccaagggaccacggtcaccgtctcctca

SEQ ID NO: 29712 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCARERYSSSWFDYGMDVWGQGTTVTVSS

SEQ ID NO: 29713 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccctcagtggttcctactggagctggatccgccagcccccagggaaggggctggagtggattggggaaatcaatcttagtggaagtaccaactacaacccgtccctcaagagtcgagtcaccatatcagtagacacgtccaagagccagttctccctgacgctgcgctctgtgaccgccgcggacacggctgtgtattactgtgcgagagactacggtggccttgactactggggccagggaaccctggtcaccgtctcctca

SEQ ID NO: 29714 - protein, 115 aa, Artificial Sequence
  Description of Artificial Sequence: Synthetic polypeptide
QVQLQQWGAGLLKPSETLSLTCAVYGGSLSGSYWSWIRQPPGKGLEWIGEINLSGSTNYNPSLKSRVTISVDTSKSQFSLTLRSVTAADTAVYYCARDYGGLDYWGQGTLVTVSS

SEQ ID NO: 29715 - DNA, 345 bp, Artificial Sequence
  Description of Artificial Sequence: Synthetic polynucleotide
caggtacaactacagcagtggggcgcaggactgttgaagccttcggagaccctgtccctcacctgcgctgtctatagtgggtccttcagtggttgctactggagctggatccgccagcccccagggaaggggctggagtggattggggaaatcaatcatagtggaagaaccaactacaacccgtccctcaagagtcgagtcaccatatcagtagacacgtccaagaaccagttctccctgaagctgagctctgtgaccgccgcggacacggctgtgtattactgtgcgagggactacggcggtatggacgtctggggccaggggaccacggtcaccgtctcctca

SEQ ID NO: 29716 - protein, 115 aa, Artificial Sequence
  Description of Artificial Sequence: Synthetic polypeptide
QVQLQQWGAGLLKPSETLSLTCAVYSGSFSGCYWSWIRQPPGKGLEWIGEINHSGRTNYNPSLKSRVTISVDTSKNQFSLKLSSVTAADTAVYYCARDYGGMDVWGQGTTVTVSS

SEQ ID NO: 29717 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctgtgcacagaagttccagggcagagtcaccatgaccaggaacacctccataagcacagcctacatggagctgagcagcctgagatctgaggacacggccgtgtattactgtgcgagtagcagtggctggaacttctttgactactggggccagggaaccctggtcaccgtctcctca

SEQ ID NO: 29718 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGCAQKFQGRVTMTRNTSISTAYMELSSLRSEDTAVYYCASSSGWNFFDYWGQGTLVTVSS

SEQ ID NO: 29719 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccggggcagagtcaccatgacctggaacacctccataagcacagcctacatggagctgagcagcctgagatctgaggacacggccgtgtattactgtgcgagtagcagtggctggtactactttgactactggggccagggaaccctggtcaccgtctcctca

SEQ ID NO: 29720 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFRGRVTMTWNTSISTAYMELSSLRSEDTAVYYCASSSGWYYFDYWGQGTLVTVSS

SEQ ID NO: 29721 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggtccctggacaagggcttgagtggatgggatggatgcaccctaacagtggtaacacaggctatgcacagaagttccagggcagagtcaccatgaccaggaacacctccatcagcacagcctacatggagctgagcagcctgagatctgaggacacggccgtgtattactgtgcgattagtagtggctggtactggttcgacccctggggccagggaaccctggtcaccgtctcctca

SEQ ID NO: 29722 - protein, 118 aa, Artificial Sequence
  Description of Artificial Sequence: Synthetic polypeptide
QVQLVQSGAEVKKPGASVKVSCKASGYTFTNYDINWVRQVPGQGLEWMGWMHPNSGNTGYAQKFQGRVTMTRNTSISTAYMELSSLRSEDTAVYYCAISSGWYWFDPWGQGTLVTVSS

SEQ ID NO: 29723 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggattcaccttcaccaattatgatatcaactgggtgcgacaggccactggacaagggcttgagtggatgggatggatgcaccctaacagtggtaacacaggctttgcacagaagttccagggcagagtcaccatgaccaggaacacctccataagcacagcctacatggaactgagcagcctgagatctgaggacacggccgtgtattactgtgcggtttccagtggctggtactggttcgacccctggggccagggaaccctggtcaccgtctcctca

SEQ ID NO: 29724 - protein, 118 aa, Artificial Sequence
  Description of Artificial Sequence: Synthetic polypeptide
QVQLVQSGAEVKKPGASVKVSCKASGFTFTNYDINWVRQATGQGLEWMGWMHPNSGNTGFAQKFQGRVTMTRNTSISTAYMELSSLRSEDTAVYYCAVSSGWYWFDPWGQGTLVTVSS

SEQ ID NO: 29725 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgattagcagtggctggtactggttcgacccctggggccagggaaccctggtcaccgtctcctca

SEQ ID NO: 29726 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAISSGWYWFDPWGQGTLVTVSS

SEQ ID NO: 29727 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatttggtatgatggaagtaataaatactatgcagactccgtgaagggccgattcaccatctccagagacaattccaagaacacgctgtttctgcaaatgaacagcctgagagccgaggacacggctgtgtattactgtgcgagcgatcgcaatatagtgggagctacttactttgagtcctggggccagggaaccctggtcaccgtctcctca

SEQ ID NO: 29728 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLFLQMNSLRAEDTAVYYCASDRNIVGATYFESWGQGTLVTVSS

SEQ ID NO: 29729 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaaggacttgagtggatgggatggatgaaccctaacagtggtaacacaggctatgcacagaagttccagggcagagtcaccatgaccaggaacacctccataagcacagcctatatggagctgagcagcctgagatctgaagacacggccgtgtattactgtgcgggtagcagtggctggtacatgtttgactactggggccagggaactctggtcaccgtctcctca

SEQ ID NO: 29730 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAGSSGWYMFDYWGQGTLVTVSS

SEQ ID NO: 29731 - DNA, 357 bp, Artificial Sequence
  Description of Artificial Sequence: Synthetic polynucleotide
cagctgcagctgcaggagtcgggcccaggactggtgaagccttcggagaccctgtccctcatctgtactgtctctggtggctccatcagcagtagtaattactactggggctggatccgccagcccccagggaaggggctggagtggattgggagtatctattatagtggatacacctcctacaacccgtccctcaagagtcgagtcaccatatccgtagactcgtccaagaaccacttctccctgaggctgagctctgtgaccgccgcagacacggctgtgtattactgtgcgagacttgactctaactggggtcttgactactggggccagggaaccctggtcaccgtctcctca

SEQ ID NO: 29732 - protein, 119 aa, Artificial Sequence
  Description of Artificial Sequence: Synthetic polypeptide
QLQLQESGPGLVKPSETLSLICTVSGGSISSSNYYWGWIRQPPGKGLEWIGSIYYSGYTSYNPSLKSRVTISVDSSKNHFSLRLSSVTAADTAVYYCARLDSNWGLDYWGQGTLVTVSS

SEQ ID NO: 29733 - DNA, 354 bp, Artificial Sequence; identical to SEQ ID NO: 28125
  Description of Artificial Sequence: Synthetic polynucleotide

SEQ ID NO: 29734 - protein, 118 aa, Artificial Sequence; identical to SEQ ID NO: 28126
  Description of Artificial Sequence: Synthetic polypeptide

SEQ ID NO: 29735 - DNA, 345 bp, Artificial Sequence
  Description of Artificial Sequence: Synthetic polynucleotide
caagtgcagctacagcagtggggcgcaggactgttgaagccttcggagcccctgtccctcacctgcgctgtctatggtgggtccttcagtggtccctactggagctggatccgccagccccccgggaaggggctggagtggattggggaaatcaatcatagtggaagcaccaactacaacccgtccctcacgagtcgagtcaccatatcagtagacacgtccaagaaccagttctccctgaaactgacctctgtgaccgccgcggactcggctgtgtattactgtgcgagagactacgggggtttggacgtctggggccaagggaccacggtcaccgtctcctca

SEQ ID NO: 29736 - protein, 115 aa, Artificial Sequence
  Description of Artificial Sequence: Synthetic polypeptide
QVQLQQWGAGLLKPSEPLSLTCAVYGGSFSGPYWSWIRQPPGKGLEWIGEINHSGSTNYNPSLTSRVTISVDTSKNQFSLKLTSVTAADSAVYYCARDYGGLDVWGQGTTVTVSS

SEQ ID NO: 29737 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtccatggtgggtccttcagtggttgctactggagctggatccgccagcccccagggaaggggctggagtggattggggaaatcaatcatagtggaagcaccaactacaacccgtccctcaagagtcgagtcaccatttcagtagacacgtccaagaaccagttctccctgaagctgagctctgtgaccgccgcggacacggctgtgtattactgtgcgagggactacggcggtatggacgtctggggccaagggaccacggtcaccgtctcctca

SEQ ID NO: 29738 - protein, 115 aa, Artificial Sequence
  Description of Artificial Sequence: Synthetic polypeptide
QVQLQQWGAGLLKPSETLSLTCAVHGGSFSGCYWSWIRQPPGKGLEWIGEINHSGSTNYNPSLKSRVTISVDTSKNQFSLKLSSVTAADTAVYYCARDYGGMDVWGQGTTVTVSS

SEQ ID NO: 29739 - DNA, 345 bp, Artificial Sequence; identical to SEQ ID NO: 29737
  Description of Artificial Sequence: Synthetic polynucleotide

SEQ ID NO: 29740 - protein, 115 aa, Artificial Sequence; identical to SEQ ID NO: 29738
  Description of Artificial Sequence: Synthetic polypeptide

SEQ ID NO: 29741 - DNA, 357 bp, Artificial Sequence
  Description of Artificial Sequence: Synthetic polynucleotide
caactgcagctgcaggagtcgggcccaggactggtgaagccttcggagaccctgtccctcacctgcagtgtctctggtggctccatcttcagaagtagttactactggggctggatccgccagcccccagggaaggggctggagtggattgggggtatctattatagtgggagcacctcctacaacccgtccctcaagagtcgagtcaccatatccgtagacacgtccgagaaccagttctccctgaagctgagctctgtgaccgccgcagacacggctgtgtattactgtgcgagactgcgacctaactgggactttgactactggggccagggaaccctggtcaccgtctcctca

SEQ ID NO: 29742 - protein, 119 aa, Artificial Sequence
  Description of Artificial Sequence: Synthetic polypeptide
QLQLQESGPGLVKPSETLSLTCSVSGGSIFRSSYYWGWIRQPPGKGLEWIGGIYYSGSTSYNPSLKSRVTISVDTSENQFSLKLSSVTAADTAVYYCARLRPNWDFDYWGQGTLVTVSS

SEQ ID NO: 29743 - DNA, 345 bp, Artificial Sequence
  Description of Artificial Sequence: Synthetic polynucleotide
caggtgcagctacaacagtggggcgcaggactgttgaagccttcggagaccctgtccctcacttgcgctgtctatggtgggtccttcagtggttgctactggagctggatccgccagcccccagggaaggggctggagtggattggggaaatcaatcatagtggatgcaccaacttcaacccgtccctcaagagtcgagtcaccatatcagttgacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 29744 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINHSGCTNFNPSLKSRVTISVDTSKNQFSLKLSSVTAADTAVYYCARDYGGMDVWGQGTTVTVSS

SEQ ID NO: 29745 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctatatggagctgagcagcctgagatctgaggacacggccgtgtattactgtgcgagtagcagtggctggtactggttcgacccctggggccagggaaccctggtcaccgtctcctca

SEQ ID NO: 29746 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYWFDPWGQGTLVTVSS

SEQ ID NO: 29747 - DNA, 354 bp, Artificial Sequence
  Description of Artificial Sequence: Synthetic polynucleotide
caggtgcagctggtgcagtctggggctgaggtgaagaagcctggggcctcagtgagggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtactactttgactactggggccagggaaccctggtcaccgtctcctca

SEQ ID NO: 29748 - protein, 118 aa, Artificial Sequence
  Description of Artificial Sequence: Synthetic polypeptide
QVQLVQSGAEVKKPGASVRVSCKASGYTFTNYDINWVRQATGQGLEWMGWMHPNSGNTGYAQKFQGRVTMTRNTSISTAYMELSSLRSEDTAVYYCAYSSGWYYFDYWGQGTLVTVSS

SEQ ID NO: 29749 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacaatggtaacacaggctatgcacagaagttccagggcagagtcaccatgaccaggaacacctccataagcacagcctacatggagctgaacagcctgagatctgaggacacggccgtgtattactgtgcgattagcagtggctggtactggttcgacccctggggccagggaaccctggtcaccgtctcctta

SEQ ID NO: 29750 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNNGNTGYAQKFQGRVTMTRNTSISTAYMELNSLRSEDTAVYYCAISSGWYWFDPWGQGTLVTVSL

SEQ ID NO: 29751 - DNA, 354 bp, Artificial Sequence; identical to SEQ ID NO: 29721
  Description of Artificial Sequence: Synthetic polynucleotide

SEQ ID NO: 29752 - protein, 118 aa, Artificial Sequence; identical to SEQ ID NO: 29722
  Description of Artificial Sequence: Synthetic polypeptide

SEQ ID NO: 29753 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgctactggagctggatccgccagcccccagggaaggggctggagtggattggggaaatcaatcatagtggaaggaccaactacaacccgtccctcaagagtcgagtcaccatatcagtagacacgtccgagaaccagttctccctgaagctgagctctgtgaccgccgcggacacggctgtgtattactgtgcgagagactacggtgggcttgactactggggccagggagccctggtcaccgtctcctca

SEQ ID NO: 29754 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINHSGRTNYNPSLKSRVTISVDTSENQFSLKLSSVTAADTAVYYCARDYGGLDYWGQGALVTVSS

SEQ ID NO: 29755 - DNA, 345 bp, Artificial Sequence
  Description of Artificial Sequence: Synthetic polynucleotide
caggtgcagttacagcagtggggcgcaggactgttgaagccttcggagaccctgtccctcacctgcgctgtctatggtgggtccctcagtggttcctactggagctggatccgccagcccccagggaaggggctggagtggattggggaaatcaatcttagtggaagcaccaactacaacccgtccctcaagagtcgagtcaccatatcagtagacacgtccaagagccagttctccctgacgctgcgctctgtgaccgccgcggacacggctgtgtattactgtgcgagagactacggtggccttgactactggggccagggaaccctggtcaccgtctcctca

SEQ ID NO: 29756 - protein, 115 aa, Artificial Sequence; identical to SEQ ID NO: 29714
  Description of Artificial Sequence: Synthetic polypeptide

SEQ ID NO: 29757 - DNA, 345 bp, Artificial Sequence
  Description of Artificial Sequence: Synthetic polynucleotide
caggtgcagctacagcaggggggcgcaggaccgttgaagccttcggagaccctgtccctcacctgcgctgtctatggtgggtccttcagtggttgctactggagctggatccgccagcccccagggaaggggctggagtggattggggaaatcaattatagtggaagaaccaactacaacccgtccctcaagagtcgagtcaccatatcagtagacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 29758 - protein, 115 aa, Artificial Sequence
  Description of Artificial Sequence: Synthetic polypeptide
QVQLQQGGAGPLKPSETLSLTCAVYGGSFSGCYWSWIRQPPGKGLEWIGEINYSGRTNYNPSLKSRVTISVDTSKNQFSLKLSSVTAADTAVYYCARDYGGMDVWGQGTTVTVSS

SEQ ID NO: 29759 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttccccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattattgtgcggtttccagtggctggcactggttcgacccctggggccagggaaccctggtcaccgtcgcctca

SEQ ID NO: 29760 - protein, 118 aa, Artificial Sequence
  Description of Artificial Sequence: Synthetic polypeptide
QVQLVQSGAEVKKPGASVKVSCKASGYTFPNYDINWVRQATGQGLEWMGWMNPNSGNTGYAQKFQGRVTMTRNTSISTAYMELSSLRSEDTAVYYCAVSSGWHWFDPWGQGTLVTVAS

SEQ ID NO: 29761 - DNA, 354 bp, Artificial Sequence; identical to SEQ ID NO: 29721
  Description of Artificial Sequence: Synthetic polynucleotide

SEQ ID NO: 29762 - protein, 118 aa, Artificial Sequence; identical to SEQ ID NO: 29722
  Description of Artificial Sequence: Synthetic polypeptide

SEQ ID NO: 29763 - DNA, 354 bp, Artificial Sequence
  Description of Artificial Sequence: Synthetic polynucleotide
gaggtgcagctggtggagtctgggggaggcttggtaaagcctggggggtcccttagactctcctgtgcagcctctggattcagtttcagtaacgcctggatgaactgggtccgccaggctccagggaaggggctggagtgggttggccgtattaaaaacaaagctgatggtgggacaacagacttcgctgcacccgtgaaaggcagattcaccatctcaagagatgattcaaaacacacgctgtatctgcaaatgaacagcctgaaaaccgaggacacagccgtgtattactgtaccacagtgggacctactacggactactggggccagggaaccctggtcaccgtctcctca

SEQ ID NO: 29764 - protein, 118 aa, Artificial Sequence
  Description of Artificial Sequence: Synthetic polypeptide
EVQLVESGGGLVKPGGSLRLSCAASGFSFSNAWMNWVRQAPGKGLEWVGRIKNKADGGTTDFAAPVKGRFTISRDDSKHTLYLQMNSLKTEDTAVYYCTTVGPTTDYWGQGTLVTVSS

SEQ ID NO: 29765 - DNA, 345 bp, Artificial Sequence
  Description of Artificial Sequence: Synthetic polynucleotide
caagtgcagctacagcagtggggcgcaggactgttgaagccttcggagcccctgtccctcacctgcgctgtctatggtgggtccttcagtggtccctactggagctggatccgccagccccccgggaaggggctggagtggattggggaaatcaatcatagtggaagcaccaactacaacccgtccctcaagagtcgagtcaccatatcagtagacacgtccaagaaccagttctccctgaaactgacctctgtgaccgccgcggacacggctgtgtattactgtgcgagagactacgggggtttggacgtctggggccaagggaccacggtcaccgtctcctca

SEQ ID NO: 29766 - protein, 115 aa, Artificial Sequence
  Description of Artificial Sequence: Synthetic polypeptide
QVQLQQWGAGLLKPSEPLSLTCAVYGGSFSGPYWSWIRQPPGKGLEWIGEINHSGSTNYNPSLKSRVTISVDTSKNQFSLKLTSVTAADTAVYYCARDYGGLDVWGQGTTVTVSS

SEQ ID NO: 29767 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatggcagctatggttatgacggccttgactactggggccagggaaccctggtcaccgtctcctca

SEQ ID NO: 29768 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDGSYGYDGLDYWGQGTLVTVSS

SEQ ID NO: 29769 - DNA, 363 bp, Artificial Sequence; identical to SEQ ID NO: 29727
  Description of Artificial Sequence: Synthetic polynucleotide

SEQ ID NO: 29770 - protein, 121 aa, Artificial Sequence; identical to SEQ ID NO: 29728
  Description of Artificial Sequence: Synthetic polypeptide

SEQ ID NO: 29771 - DNA, 372 bp, Artificial Sequence
  Description of Artificial Sequence: Synthetic polynucleotide
caggtgcaggtacagcagtggggcgcaggactgttgaagccttcggagaccctgtccctcacctgcgctgtctatggtgggtccttcactgattactactggagctggatccgccagcccccagggaaggggctggagtggattggggaaatcaatcatagtggagacaccaactacaacccgtccctcaagagtcgagtcaccatatcagtagacacgtccaagaaccagttctccctgaagctgagttctgtgaccgccgcggacacggctgtgtattactgtgcgagagagtttccatatagtggaagctacctctactactacggtatggacgtctggggccaagggaccacggtcaccgtctcctca

SEQ ID NO: 29772 - protein, 124 aa, Artificial Sequence
  Description of Artificial Sequence: Synthetic polypeptide
QVQVQQWGAGLLKPSETLSLTCAVYGGSFTDYYWSWIRQPPGKGLEWIGEINHSGDTNYNPSLKSRVTISVDTSKNQFSLKLSSVTAADTAVYYCAREFPYSGSYLYYYGMDVWGQGTTVTVSS

SEQ ID NO: 29773 - DNA, 345 bp, Artificial Sequence
  Description of Artificial Sequence: Synthetic polynucleotide
caggtgcagctacaacagtggggcgcaggactgttgaagccttcggagaccctgtccctcacttgcgctgtcaatggtgggcccttcagtggttgctactggagctggatccgccagcccccagggaaggggctggagtggattggggaaatcaatcatagtggaaggaccaacttcaacccgtccctcaagagtcgagtcaccatatcagttgacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 29774 - protein, 115 aa, Artificial Sequence
  Description of Artificial Sequence: Synthetic polypeptide
QVQLQQWGAGLLKPSETLSLTCAVNGGPFSGCYWSWIRQPPGKGLEWIGEINHSGRTNFNPSLKSRVTISVDTSKNQFSLKLSSVTAADTAVYYCARDYGGMDVWGQGTTVTVSS

SEQ ID NO: 29775 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagactcaccatgaccaggaacacctccataagcacagcctacatggagctgagcagcctgagatctgaggacacggccgtgttttactgtgcatatagcagtggctggtactactttgactactggggccagggaaccctggtcaccgtctcctca

SEQ ID NO: 29776 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRLTMTRNTSISTAYMELSSLRSEDTAVFYCAYSSGWYYFDYWGQGTLVTVSS

SEQ ID NO: 29777 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcatcctaacagtggtaacacaggctatgcacagaagttccagggcagagtcaccatgaccaggaacacctccataagcacagcctacatggaactgagcagcctgagatctgaggacacggccgtgtattactgtgcgagtagcagtggctggtactactttgactactggggccagggaaccctggtcaccgtctcctca

SEQ ID NO: 29778 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCASSSGWYYFDYWGQGTLVTVSS

SEQ ID NO: 29779 - DNA, 345 bp, Artificial Sequence; identical to SEQ ID NO: 29737
  Description of Artificial Sequence: Synthetic polynucleotide

SEQ ID NO: 29780 - protein, 115 aa, Artificial Sequence; identical to SEQ ID NO: 29738
  Description of Artificial Sequence: Synthetic polypeptide

SEQ ID NO: 29781 - DNA, 345 bp, Artificial Sequence; identical to SEQ ID NO: 29737
  Description of Artificial Sequence: Synthetic polynucleotide

SEQ ID NO: 29782 - protein, 115 aa, Artificial Sequence; identical to SEQ ID NO: 29738
  Description of Artificial Sequence: Synthetic polypeptide

SEQ ID NO: 29783 - DNA, 375 bp, Artificial Sequence
  Description of Artificial Sequence: Synthetic polynucleotide
gaggtgcagctggtggagtctgggggaggcttggtacagccgggggggtccctgagactctcctgtgcagcctctggattcaccttcagtaactacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagttcttgactacggtgactccttgggctactactactacggtatggacgtctggggccaagggaccacggtcaccgtctcctca

SEQ ID NO: 29784 - protein, 125 aa, Artificial Sequence
  Description of Artificial Sequence: Synthetic polypeptide
EVQLVESGGGLVQPGGSLRLSCAASGFTFSNYDMHWVRQATGKGLEWVSAIGTAGDTYYPGSVKGRFTISRENAKNSLYLQMNSLRAGDTAVYYCARVLDYGDSLGYYYYGMDVWGQGTTVTVSS

SEQ ID NO: 29785 - DNA, 345 bp, Artificial Sequence
  Description of Artificial Sequence: Synthetic polynucleotide
caggtgcagctacagcagtggggcgcaggactgttgaagccttcggagaccctgtccctcaaatgcgatgtctatggtgggtccttcagtggttactactggagctggatccgccagcccccagggaaggggctggagtggattggggaaatcaatcacagtggaagcaccaactacaacccgtccctcaagagtcgagtcaccatatcagtagacacgtccaagaaccagttctccctgaagctgagctctgtgaccgccgcggacacggctgtgtattactgtgcgagagactacggtggtttggacgtctggggccaagggaccacggtcaccgtctcctca

SEQ ID NO: 29786 - protein, 115 aa, Artificial Sequence
  Description of Artificial Sequence: Synthetic polypeptide
QVQLQQWGAGLLKPSETLSLKCDVYGGSFSGYYWSWIRQPPGKGLEWIGEINHSGSTNYNPSLKSRVTISVDTSKNQFSLKLSSVTAADTAVYYCARDYGGLDVWGQGTTVTVSS

SEQ ID NO: 29787 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaattatggcatgcactgggtccgccaggctccaggcaaggggctggagtgggtggcagttatatggtatgatggaagaaataaatactatgcagactccgtgaagggccgattcaccatctccagagacaattccaagaacacgctgtatctgcaaatgaacagcctgagagccgaggacacggctctatattactgtgcgagagatcggagtatattgggagctactttctttgactactggggccagggaaccctggtcaccgtctcctca

SEQ ID NO: 29788 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAVIWYDGRNKYYADSVKGRFTISRDNSKNTLYLQMNSLRAEDTALYYCARDRSILGATFFDYWGQGTLVTVSS

SEQ ID NO: 29789 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgctactggagctggatccgccagcccccagggaaggggctggagtggattggggaaatcaatcatagtggaaggaccaactacaacccgtccctcaagagtcgagtcaccatctcagtagacacgtccgagaaccagttctccctgaagttgagctctgtgaccgccgcggacacggctgtgtattactgtgcgagagactacggtgggcttgactactggggccagggaaccctggtcaccgtctcctca

SEQ ID NO: 29790 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINHSGRTNYNPSLKSRVTISVDTSENQFSLKLSSVTAADTAVYYCARDYGGLDYWGQGTLVTVSS

SEQ ID NO: 29791 - DNA, 360 bp, Artificial Sequence
  Description of Artificial Sequence: Synthetic polynucleotide
caggtgcagctggtggagtctgggggaggcgtggtccagtctgggaggtccctgagactctcctgtgcagcgtctggattcaccttcagtagctatggcatgcactgggtccgccaggctccaggcaaggggctggagtgggtggcagttatatggtatgatggaagtaatcaaaactatgcagactccgtgaagggccgattcaccatctccagagacaattccaagaacacgctgtttctgcaaatgaacagcctgagagccgaggacacggctgtgtattactgtgcgagagatggcagctatggttacgacggccttgactactggggccagggaaccctggtcaccgtctcctca

SEQ ID NO: 29792 - protein, 120 aa, Artificial Sequence
  Description of Artificial Sequence: Synthetic polypeptide
QVQLVESGGGVVQSGRSLRLSCAASGFTFSSYGMHWVRQAPGKGLEWVAVIWYDGSNQNYADSVKGRFTISRDNSKNTLFLQMNSLRAEDTAVYYCARDGSYGYDGLDYWGQGTLVTVSS

SEQ ID NO: 29793 - DNA, 354 bp, Artificial Sequence; identical to SEQ ID NO: 29759
  Description of Artificial Sequence: Synthetic polynucleotide

SEQ ID NO: 29794 - protein, 118 aa, Artificial Sequence; identical to SEQ ID NO: 29760
  Description of Artificial Sequence: Synthetic polypeptide

SEQ ID NO: 29795 - DNA, 345 bp, Artificial Sequence; identical to SEQ ID NO: 29737
  Description of Artificial Sequence: Synthetic polynucleotide

SEQ ID NO: 29796 - protein, 115 aa, Artificial Sequence; identical to SEQ ID NO: 29738
  Description of Artificial Sequence: Synthetic polypeptide

SEQ ID NO: 29797 - DNA, 345 bp, Artificial Sequence; identical to SEQ ID NO: 29737
  Description of Artificial Sequence: Synthetic polynucleotide

SEQ ID NO: 29798 - protein, 115 aa, Artificial Sequence; identical to SEQ ID NO: 29738
  Description of Artificial Sequence: Synthetic polypeptide

SEQ ID NO: 29799 - DNA, 354 bp, Artificial Sequence; identical to SEQ ID NO: 29749
  Description of Artificial Sequence: Synthetic polynucleotide

SEQ ID NO: 29800 - protein, 118 aa, Artificial Sequence; identical to SEQ ID NO: 29750
  Description of Artificial Sequence: Synthetic polypeptide

SEQ ID NO: 29801 - DNA, 345 bp, Artificial Sequence; identical to SEQ ID NO: 29757
  Description of Artificial Sequence: Synthetic polynucleotide

SEQ ID NO: 29802 - protein, 115 aa, Artificial Sequence; identical to SEQ ID NO: 29758
  Description of Artificial Sequence: Synthetic polypeptide

SEQ ID NO: 29803 - DNA, 354 bp, Artificial Sequence; identical to SEQ ID NO: 29721
  Description of Artificial Sequence: Synthetic polynucleotide

SEQ ID NO: 29804 - protein, 118 aa, Artificial Sequence; identical to SEQ ID NO: 29722
  Description of Artificial Sequence: Synthetic polypeptide

SEQ ID NO: 29805 - DNA, 345 bp, Artificial Sequence
  Description of Artificial Sequence: Synthetic polynucleotide
caggtgcagctacaacaggggggcgcaggaccgttgaagccttcggagaccctgtccctcacctgcgctgtctatggtgggtccttcagtggttgctactggagctggatccgccagcccccagggaaggggctggagtggattggggaaatcaattatagtggaagaaccaactacaacccgtccctcaagagtcgagtcaccatatcagtagacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 29806 - protein, 115 aa, Artificial Sequence; identical to SEQ ID NO: 29758
  Description of Artificial Sequence: Synthetic polypeptide

SEQ ID NO: 29807 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcgattagcagtggctggtactggttcgacccctggggccagggaaccctggtcaccgtctcctca

SEQ ID NO: 29808 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAISSGWYWFDPWGQGTLVTVSS

SEQ ID NO: 29809 - DNA, 354 bp, Artificial Sequence; identical to SEQ ID NO: 29721
  Description of Artificial Sequence: Synthetic polynucleotide

SEQ ID NO: 29810 - protein, 118 aa, Artificial Sequence; identical to SEQ ID NO: 29722
  Description of Artificial Sequence: Synthetic polypeptide

SEQ ID NO: 29811 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtggggccttcagtggttcctactggagctggatccgccagtccccagggaaggggctggagtggattggggaaatcaattataggggaagcaccaactacaacccgtccctcaagagtcgagtcaccatatcagtagacacgtccaagaaccagttctccctgaacctgagctctgtgaccgccgcggacacggctgtgtattactgtgcgagggactacggcggtatggacgtctggggccaagggaccacggtcaccgtctcctca

SEQ ID NO: 29812 - protein, 115 aa, Artificial Sequence
  Description of Artificial Sequence: Synthetic polypeptide
QVQLQQWGAGLLKPSETLSLTCAVYGGAFSGSYWSWIRQSPGKGLEWIGEINYRGSTNYNPSLKSRVTISVDTSKNQFSLNLSSVTAADTAVYYCARDYGGMDVWGQGTTVTVSS

SEQ ID NO: 29813 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgattagcagtggctggtactggttcgacccctggggccagggaaccctggtcaccgtctcctca

SEQ ID NO: 29814 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSINTAYMELSSLRSEDTAVYYCAISSGWYWFDPWGQGTLVTVSS

SEQ ID NO: 29815 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatggcagctatggttacgacggccttgactactggggccagggaaccctggtcaccgtctcctca

SEQ ID NO: 29816 - protein, 120 aa, Artificial Sequence; identical to SEQ ID NO: 29768
  Description of Artificial Sequence: Synthetic polypeptide

SEQ ID NO: 29817 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaatagtggtaacacaggctatgcacagaagttccagggcagagtcaccctgaccaggaacacctccataagcacagcctacatggagctgagcagcctgagatctgaggacacggccgtgtattactgtgcggtttccagtggctggtactggttcgacccctggggccagggaaccctggtcaccgtctcctca

SEQ ID NO: 29818 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTLTRNTSISTAYMELSSLRSEDTAVYYCAVSSGWYWFDPWGQGTLVTVSS

SEQ ID NO: 29819 - DNA, 354 bp, Artificial Sequence; identical to SEQ ID NO: 29807
  Description of Artificial Sequence: Synthetic polynucleotide

SEQ ID NO: 29820 - protein, 118 aa, Artificial Sequence; identical to SEQ ID NO: 29808
  Description of Artificial Sequence: Synthetic polypeptide

SEQ ID NO: 29821 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaataccatgcagactccgtgaagggccgattcaccatctccagagacaattccaagaacacgctgtatctgcaaatgaacagcctgagagccgaggacacggctatgtattactgtgcgagagatgaggggttcggggagttcgactactacaactacggtatggacgtctggggccaagggaccacggtcaccgtctcctca

SEQ ID NO: 29822 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYHADSVKGRFTISRDNSKNTLYLQMNSLRAEDTAMYYCARDEGFGEFDYYNYGMDVWGQGTTVTVSS

SEQ ID NO: 29823 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctttggcatgcactgggcccgccaggctccaggcaaggggctggaatgggtggcagctatttggtatgatggaagtaataaatactgtgcagactccgtgaagggccgattcaccatctccagagacaattccaagaacacactgtctctgcaaatgaacagcctgagagccgaggactcggctgtgtattactgtgcgagagatcggagtatactgggagctgctttctttgactactggggccagggaaccctggtcaccgtctcctca

SEQ ID NO: 29824 - protein, 121 aa, Artificial Sequence
  Description of Artificial Sequence: Synthetic polypeptide
QVQLVESGGGVVQPGRSLRLSCAASGFTFSSFGMHWARQAPGKGLEWVAAIWYDGSNKYCADSVKGRFTISRDNSKNTLSLQMNSLRAEDSAVYYCARDRSILGAAFFDYWGQGTLVTVSS

SEQ ID NO: 29825 - DNA, 354 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccgtattaaaaacaaagctgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagtgggagctactacggactactggggccagggaaccctggtcaccgtctcctca

SEQ ID NO: 29826 - protein, 118 aa, Artificial Sequence
  Description of Artificial Sequence: Synthetic polypeptide
EVQLVESGGGLVKPGGSLRLSCAASGFTFSNAWMNWVRQAPGKGLEWVGRIKNKADGGTTDYAAPVKGRFTISRDDSKNTLYLQMNSLKTEDTAVYYCTTVGATTDYWGQGTLVTVSS

SEQ ID NO: 29827 - DNA, 354 bp, Artificial Sequence; identical to SEQ ID NO: 28201
  Description of Artificial Sequence: Synthetic polynucleotide

SEQ ID NO: 29828 - protein, 118 aa, Artificial Sequence; identical to SEQ ID NO: 28202
  Description of Artificial Sequence: Synthetic polypeptide

SEQ ID NO: 29829 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccctcagtggttcctactggagctggatccgccagcccccagggaaggggctggagtggattggggaaatcaatcttagtggaagcaccaactacaacccgtccctcaagagtcgagtcaccatatcagtagacacgtccaagagccagttctccctgacgctgcgctctgtgaccgccgcggacacggctgtgtattactgtgcgagagactacggtggccttgactactggggccagggaaccctggtcaccgtctcctca

SEQ ID NO: 29830 - protein, 115 aa, Artificial Sequence; identical to SEQ ID NO: 29714
  Description of Artificial Sequence: Synthetic polypeptide

SEQ ID NO: 29831 - DNA, 354 bp, Artificial Sequence; identical to SEQ ID NO: 29759
  Description of Artificial Sequence: Synthetic polynucleotide

SEQ ID NO: 29832 - protein, 118 aa, Artificial Sequence; identical to SEQ ID NO: 29760
  Description of Artificial Sequence: Synthetic polypeptide

SEQ ID NO: 29833 - DNA, 354 bp, Artificial Sequence; identical to SEQ ID NO: 29717
  Description of Artificial Sequence: Synthetic polynucleotide

SEQ ID NO: 29834 - protein, 118 aa, Artificial Sequence; identical to SEQ ID NO: 29718
  Description of Artificial Sequence: Synthetic polypeptide

SEQ ID NO: 29835 - DNA, 354 bp, Artificial Sequence; identical to SEQ ID NO: 28125
  Description of Artificial Sequence: Synthetic polynucleotide

SEQ ID NO: 29836 - protein, 118 aa, Artificial Sequence; identical to SEQ ID NO: 28126
  Description of Artificial Sequence: Synthetic polypeptide

SEQ ID NO: 29837 - DNA, 354 bp, Artificial Sequence; identical to SEQ ID NO: 29759
  Description of Artificial Sequence: Synthetic polynucleotide

SEQ ID NO: 29838 - protein, 118 aa, Artificial Sequence; identical to SEQ ID NO: 29760
  Description of Artificial Sequence: Synthetic polypeptide

SEQ ID NO: 29839 - DNA, 345 bp, Artificial Sequence; identical to SEQ ID NO: 29737
  Description of Artificial Sequence: Synthetic polynucleotide

SEQ ID NO: 29840 - protein, 115 aa, Artificial Sequence; identical to SEQ ID NO: 29738
  Description of Artificial Sequence: Synthetic polypeptide

SEQ ID NO: 29841 - DNA, 345 bp, Artificial Sequence; identical to SEQ ID NO: 29737
  Description of Artificial Sequence: Synthetic polynucleotide

SEQ ID NO: 29842 - protein, 115 aa, Artificial Sequence; identical to SEQ ID NO: 29738
  Description of Artificial Sequence: Synthetic polypeptide

SEQ ID NO: 29843 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatgtcaactgggtgcgacaggccactggacaagggcttgaatggatgggatggatgcaccctaacagtggtaacacaggctatgcacagaagttccagggcagagtcaccatgaccaggaacacctccatacgcacagcctacatggagctgagcagcctgagatctgaggacacggccgtgtattactgtgcgagtagcagtggctggtaccattttgactactggggccagggaaccctggtcaccgtctcctca

SEQ ID NO: 29844 - protein, 118 aa, Artificial Sequence
  Description of Artificial Sequence: Synthetic polypeptide
QVQLVQSGAEVKKPGASVKVSCKASGYTFTNYDVNWVRQATGQGLEWMGWMHPNSGNTGYAQKFQGRVTMTRNTSIRTAYMELSSLRSEDTAVYYCASSSGWYHFDYWGQGTLVTVSS

SEQ ID NO: 29845 - DNA, 360 bp, Artificial Sequence
  Description of Artificial Sequence: Synthetic polynucleotide
caggtgcagttggtggagtctgggggaggcgtggtccagtctgggaggtccctgagactctcctgtgcagcgtctggattcaccttcagtaactatggcatgcactgggtccgccaggctccaggcaaggggctggagtgggtggcagttatatggtatgatggaagtaatcaaaactatgcagactccgtgaagggccgattcaccatctccagagacaattccaagaacacgctgtttctgcaaatgaacagcctgagagccgaggacacggctgtgtactactgtgcgagagatggcagctatggttatgacggccttgactactggggccagggaaccctggtcaccgtctcctca

SEQ ID NO: 29846 - protein, 120 aa, Artificial Sequence
  Description of Artificial Sequence: Synthetic polypeptide
QVQLVESGGGVVQSGRSLRLSCAASGFTFSNYGMHWVRQAPGKGLEWVAVIWYDGSNQNYADSVKGRFTISRDNSKNTLFLQMNSLRAEDTAVYYCARDGSYGYDGLDYWGQGTLVTVSS

SEQ ID NO: 29847 - DNA, 354 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtaacgcctggatgaactgggtccgccaggctccagggaaggggctggagtgggttggccgaattaaaaacaaaattgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagtgggagctactacggactactggggccagggaaccctggtcaccgtctcctca

SEQ ID NO: 29848 - protein, 118 aa, Artificial Sequence
  Description of Artificial Sequence: Synthetic polypeptide
EVQLVESGGGLVKPGGSLRLSCAASGFTFSNAWMNWVRQAPGKGLEWVGRIKNKIDGGTTDYAAPVKGRFTISRDDSKNTLYLQMNSLKTEDTAVYYCTTVGATTDYWGQGTLVTVSS

SEQ ID NO: 29849 - DNA, 363 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtagctatggcatgcactgggtccgccaggctccaggcaaggggctggagtgggtggcagttatttggtatgatggaagtaataaatactatgcagactccgtgaagggccgattcaccatctccagagacaattccaagaacacgctgtttctgcaaatgaacagcctgagagccgaggacacggctgtgtattactgtgcgagcgatcgcaatatagtgggagctacttactttgagtcctggggccagggaaccctggtcaccgtctcctca

SEQ ID NO: 29850 - protein, 121 aa, Artificial Sequence
  Description of Artificial Sequence: Synthetic polypeptide
QVQLVESGGGVVQPGRSLRLSCTASGFTFSSYGMHWVRQAPGKGLEWVAVIWYDGSNKYYADSVKGRFTISRDNSKNTLFLQMNSLRAEDTAVYYCASDRNIVGATYFESWGQGTLVTVSS

SEQ ID NO: 29851 - DNA, 354 bp, Artificial Sequence; identical to SEQ ID NO: 29723
  Description of Artificial Sequence: Synthetic polynucleotide

SEQ ID NO: 29852 - protein, 118 aa, Artificial Sequence; identical to SEQ ID NO: 29724
  Description of Artificial Sequence: Synthetic polypeptide

SEQ ID NO: 29853 - DNA, 354 bp, Artificial Sequence; identical to SEQ ID NO: 28201
  Description of Artificial Sequence: Synthetic polynucleotide

SEQ ID NO: 29854 - protein, 118 aa, Artificial Sequence; identical to SEQ ID NO: 28202
  Description of Artificial Sequence: Synthetic polypeptide

SEQ ID NO: 29855 - DNA, 354 bp, Artificial Sequence; identical to SEQ ID NO: 29777
  Description of Artificial Sequence: Synthetic polynucleotide

SEQ ID NO: 29856 - protein, 118 aa, Artificial Sequence; identical to SEQ ID NO: 29778
  Description of Artificial Sequence: Synthetic polypeptide

SEQ ID NO: 29857 - DNA, 345 bp, Artificial Sequence; identical to SEQ ID NO: 29737
  Description of Artificial Sequence: Synthetic polynucleotide

SEQ ID NO: 29858 - protein, 115 aa, Artificial Sequence; identical to SEQ ID NO: 29738
  Description of Artificial Sequence: Synthetic polypeptide

SEQ ID NO: 29859 - DNA, 354 bp, Artificial Sequence; identical to SEQ ID NO: 28125
  Description of Artificial Sequence: Synthetic polynucleotide

SEQ ID NO: 29860 - protein, 118 aa, Artificial Sequence; identical to SEQ ID NO: 28126
  Description of Artificial Sequence: Synthetic polypeptide

SEQ ID NO: 29861 - DNA, 345 bp, Artificial Sequence
  Description of Artificial Sequence: Synthetic polynucleotide
caggtgcagctacagcagtggggcgcaggactgttgaagccttcggagaccctgtccctcacctgcactgtctatggtggggccttcagtggttcctactggagctggatccgccagtccccagggaaggggctggagtggattggggaaatcaattataggggaagcaccaactacaacccgtccctcaagagtcgagtcaccatatcagtagacacgtccaagaaccagttctccctgaacctgagctctgtgaccgccgcggacacggctgtgtattactgtgcgagggactacggcggtatggacgtctggggccaagggaccacggtcaccgtctcctca

SEQ ID NO: 29862 - protein, 115 aa, Artificial Sequence
  Description of Artificial Sequence: Synthetic polypeptide
QVQLQQWGAGLLKPSETLSLTCTVYGGAFSGSYWSWIRQSPGKGLEWIGEINYRGSTNYNPSLKSRVTISVDTSKNQFSLNLSSVTAADTAVYYCARDYGGMDVWGQGTTVTVSS

SEQ ID NO: 29863 - DNA, 345 bp, Artificial Sequence; identical to SEQ ID NO: 29737
  Description of Artificial Sequence: Synthetic polynucleotide

SEQ ID NO: 29864 - protein, 115 aa, Artificial Sequence; identical to SEQ ID NO: 29738
  Description of Artificial Sequence: Synthetic polypeptide

SEQ ID NO: 29865 - DNA, 354 bp, Artificial Sequence
  Description of Artificial Sequence: Synthetic polynucleotide
caggtgcagctggtgcagtctggggctgaggtgaagaagcctggggcctctgtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccagaaacacctccataagcacagcctacatggagctgagcagcctgagatctgaggacacggccgtatattactgtgcgagtagcagtggctggtacttctttgactactggggccagggaaccctggtcaccctctcctca

SEQ ID NO: 29866 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYFFDYWGQGTLVTLSS

SEQ ID NO: 29867 - DNA, 345 bp, Artificial Sequence; identical to SEQ ID NO: 29737
  Description of Artificial Sequence: Synthetic polynucleotide

SEQ ID NO: 29868 - protein, 115 aa, Artificial Sequence; identical to SEQ ID NO: 29738
  Description of Artificial Sequence: Synthetic polypeptide

SEQ ID NO: 29869 - DNA, 345 bp, Artificial Sequence; identical to SEQ ID NO: 29737
  Description of Artificial Sequence: Synthetic polynucleotide

SEQ ID NO: 29870 - protein, 115 aa, Artificial Sequence; identical to SEQ ID NO: 29738
  Description of Artificial Sequence: Synthetic polypeptide

SEQ ID NO: 29871 - DNA, 345 bp, Artificial Sequence; identical to SEQ ID NO: 29737
  Description of Artificial Sequence: Synthetic polynucleotide

SEQ ID NO: 29872 - protein, 115 aa, Artificial Sequence; identical to SEQ ID NO: 29738
  Description of Artificial Sequence: Synthetic polypeptide

SEQ ID NO: 29873 - DNA, 354 bp, Artificial Sequence; identical to SEQ ID NO: 29721
  Description of Artificial Sequence: Synthetic polynucleotide

SEQ ID NO: 29874 - protein, 118 aa, Artificial Sequence; identical to SEQ ID NO: 29722
  Description of Artificial Sequence: Synthetic polypeptide

SEQ ID NO: 29875 - DNA, 354 bp, Artificial Sequence; identical to SEQ ID NO: 29807
  Description of Artificial Sequence: Synthetic polynucleotide

SEQ ID NO: 29876 - protein, 118 aa, Artificial Sequence; identical to SEQ ID NO: 29808
  Description of Artificial Sequence: Synthetic polypeptide

SEQ ID NO: 29877 - DNA, 345 bp, Artificial Sequence; identical to SEQ ID NO: 29737
  Description of Artificial Sequence: Synthetic polynucleotide

SEQ ID NO: 29878 - protein, 115 aa, Artificial Sequence; identical to SEQ ID NO: 29738
  Description of Artificial Sequence: Synthetic polypeptide

SEQ ID NO: 29879 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttgaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggaactgagcagcctgagatctgaggacacggccgtgtattactgtgggagtaccagtggctggaacttctttgactactggggccagggaaccctggtcaccgtctcctca

SEQ ID NO: 29880 - protein, 118 aa, Artificial Sequence
  Description of Artificial Sequence: Synthetic polypeptide
QVQLVQSGAEVKKPGASVKVSCKASGYTLTNYDINWVRQATGQGLEWMGWMNPNSGNTGYAQKFQGRVTMTRNTSISTAYMELSSLRSEDTAVYYCGSTSGWNFFDYWGQGTLVTVSS

SEQ ID NO: 29881 - DNA, 345 bp, Artificial Sequence
  Description of Artificial Sequence: Synthetic polynucleotide
caagtgcagctacagcagtggggcgcaggactgttgaagccttcggagcccctgtccctcacctgcgctgtctatggtgggtccttcagtggtccctactggagctggatccgccagccccccgggaaggggctggagtggattggggaaatcaatcatagtggaagcaccaactacaacccgtccctcaagagtcgagtcaccatatcagtagacacgtccaagaaccagttctccctgaaactgacctctgtgaccgccgcggacatggctgtgtattactgtgcgagagactacgggggtttggacgtctggggccaagggaccacggtcaccgtctcctca

SEQ ID NO: 29882 - protein, 115 aa, Artificial Sequence
  Description of Artificial Sequence: Synthetic polypeptide
QVQLQQWGAGLLKPSEPLSLTCAVYGGSFSGPYWSWIRQPPGKGLEWIGEINHSGSTNYNPSLKSRVTISVDTSKNQFSLKLTSVTAADMAVYYCARDYGGLDVWGQGTTVTVSS

SEQ ID NO: 29883 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgctactggagctggatccgccagcccccaggaaaggggctggagtggattggggaaatcaatcatagtggaaggaccaactacaacccgtccctcaagagtcgagtcaccatatcagtagacacgtccgagaagcagttctccctgaagctgagctctgtgaccgccgcggacacggctgtgtattactgtgcgagagactacggtgggcttgactactggggccagggaaccctggtcaccgtctcctca

SEQ ID NO: 29884 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINHSGRTNYNPSLKSRVTISVDTSEKQFSLKLSSVTAADTAVYYCARDYGGLDYWGQGTLVTVSS

SEQ ID NO: 29885 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatgttgggtccttcagtggttcctactggagctggatccgccagcccccagggaaggggctagagtggattggggaaatcaatcaaagtggacgcaccaactacaacccgtccctcaagagtcgagtcaccatatcagtagacacgtccaagaaccagttctccctgaagctgagctctgtgaccgccgcggacacggctgtgtattactgtgcgagagactacgggggtatagacgtctggggccaagggaccacggtcaccgtctcctca

SEQ ID NO: 29886 - protein, 115 aa, Artificial Sequence
  Description of Artificial Sequence: Synthetic polypeptide
QVQLQQWGAGLLKPSETLSLTCAVYVGSFSGSYWSWIRQPPGKGLEWIGEINQSGRTNYNPSLKSRVTISVDTSKNQFSLKLSSVTAADTAVYYCARDYGGIDVWGQGTTVTVSS

SEQ ID NO: 29887 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaagacttctggatacaccttcaccaattatgatatcaactgggtgcgacaggccactggacaagggcttgagtggatgggatggatgaaccctaacagtggtaacacaggctatgcacagaagttccaggtcagagtcaccatgaccaggaacacctccataagcacagcctacatggagctgagcagcctgagatctgaggacacggccgtctattactgtgcgtatagcagtggctggtacatctttgactactggggccagggaaccctggtcaccgtctcctca

SEQ ID NO: 29888 - protein, 118 aa, Artificial Sequence
  Description of Artificial Sequence: Synthetic polypeptide
QVQLVQSGAEVKKPGASVKVSCKTSGYTFTNYDINWVRQATGQGLEWMGWMNPNSGNTGYAQKFQVRVTMTRNTSISTAYMELSSLRSEDTAVYYCAYSSGWYIFDYWGQGTLVTVSS

SEQ ID NO: 29889 - DNA, 354 bp, Artificial Sequence; identical to SEQ ID NO: 29807
  Description of Artificial Sequence: Synthetic polynucleotide

SEQ ID NO: 29890 - protein, 118 aa, Artificial Sequence; identical to SEQ ID NO: 29808
  Description of Artificial Sequence: Synthetic polypeptide

SEQ ID NO: 29891 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgctactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagactacggtgggcttgactactggggccagggaaccctggtcaccgtctcctca

SEQ ID NO: 29892 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINHSGSTNYNPSLKSRVTISVDTSKNQFSLKLSSVTAADTAVYYCARDYGGLDYWGQGTLVTVSS

SEQ ID NO: 29893 - DNA, 360 bp, Artificial Sequence; identical to SEQ ID NO: 29767
  Description of Artificial Sequence: Synthetic polynucleotide

SEQ ID NO: 29894 - protein, 120 aa, Artificial Sequence; identical to SEQ ID NO: 29768
  Description of Artificial Sequence: Synthetic polypeptide

SEQ ID NO: 29895 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagcagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtctctgcaaatgaacagcctgagagccgaggacacggctgtgtattactgtgcgagagatggcagctatgggtatgacggccttgactactggggccagggaaccctggtcaccgtctcctca

SEQ ID NO: 29896 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLSLQMNSLRAEDTAVYYCARDGSYGYDGLDYWGQGTLVTVSS

SEQ ID NO: 29897 - DNA, 345 bp, Artificial Sequence; identical to SEQ ID NO: 29737
  Description of Artificial Sequence: Synthetic polynucleotide

SEQ ID NO: 29898 - protein, 115 aa, Artificial Sequence; identical to SEQ ID NO: 29738
  Description of Artificial Sequence: Synthetic polypeptide

SEQ ID NO: 29899 - DNA, 354 bp, Artificial Sequence; identical to SEQ ID NO: 29749
  Description of Artificial Sequence: Synthetic polynucleotide

SEQ ID NO: 29900 - protein, 118 aa, Artificial Sequence; identical to SEQ ID NO: 29750
  Description of Artificial Sequence: Synthetic polypeptide

SEQ ID NO: 29901 - DNA, 345 bp, Artificial Sequence; identical to SEQ ID NO: 29737
  Description of Artificial Sequence: Synthetic polynucleotide

SEQ ID NO: 29902 - protein, 115 aa, Artificial Sequence; identical to SEQ ID NO: 29738
  Description of Artificial Sequence: Synthetic polypeptide

SEQ ID NO: 29903 - DNA, 345 bp, Artificial Sequence; identical to SEQ ID NO: 29737
  Description of Artificial Sequence: Synthetic polynucleotide

SEQ ID NO: 29904 - protein, 115 aa, Artificial Sequence; identical to SEQ ID NO: 29738
  Description of Artificial Sequence: Synthetic polypeptide

SEQ ID NO: 29905 - DNA, 354 bp, Artificial Sequence; identical to SEQ ID NO: 28125
  Description of Artificial Sequence: Synthetic polynucleotide

SEQ ID NO: 29906 - protein, 118 aa, Artificial Sequence; identical to SEQ ID NO: 28126
  Description of Artificial Sequence: Synthetic polypeptide

SEQ ID NO: 29907 - DNA, 354 bp, Artificial Sequence; identical to SEQ ID NO: 29807
  Description of Artificial Sequence: Synthetic polynucleotide

SEQ ID NO: 29908 - protein, 118 aa, Artificial Sequence; identical to SEQ ID NO: 29808
  Description of Artificial Sequence: Synthetic polypeptide

SEQ ID NO: 29909 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggtccctactggagctggatccgccagcccccagggaaggggctggagtggattggggaaatcaattataggggaagcaccaactacaacccgtccctcaagagtcgagtcaccatttcagtagacacgtccaagaaccagttctccctgaacctgagctctgtgaccgccgcggacacggctgtgtattactgtgcgagggactacggcggtatggacgtctggggccaagggaccacggtcaccgtctcctca

SEQ ID NO: 29910 - protein, 115 aa, Artificial Sequence
  Description of Artificial Sequence: Synthetic polypeptide
QVQLQQWGAGLLKPSETLSLTCAVYGGSFSGPYWSWIRQPPGKGLEWIGEINYRGSTNYNPSLKSRVTISVDTSKNQFSLNLSSVTAADTAVYYCARDYGGMDVWGQGTTVTVSS

SEQ ID NO: 29911 - DNA, 345 bp, Artificial Sequence; identical to SEQ ID NO: 29737
  Description of Artificial Sequence: Synthetic polynucleotide

SEQ ID NO: 29912 - protein, 115 aa, Artificial Sequence; identical to SEQ ID NO: 29738
  Description of Artificial Sequence: Synthetic polypeptide

SEQ ID NO: 29913 - DNA, 354 bp, Artificial Sequence; identical to SEQ ID NO: 29749
  Description of Artificial Sequence: Synthetic polynucleotide

SEQ ID NO: 29914 - protein, 118 aa, Artificial Sequence; identical to SEQ ID NO: 29750
  Description of Artificial Sequence: Synthetic polypeptide

SEQ ID NO: 29915 - DNA, 354 bp, Artificial Sequence; identical to SEQ ID NO: 29721
  Description of Artificial Sequence: Synthetic polynucleotide

SEQ ID NO: 29916 - protein, 118 aa, Artificial Sequence; identical to SEQ ID NO: 29722
  Description of Artificial Sequence: Synthetic polypeptide

SEQ ID NO: 29917 - DNA, 354 bp, Artificial Sequence; identical to SEQ ID NO: 29721
  Description of Artificial Sequence: Synthetic polynucleotide

SEQ ID NO: 29918 - protein, 118 aa, Artificial Sequence; identical to SEQ ID NO: 29722
  Description of Artificial Sequence: Synthetic polypeptide

SEQ ID NO: 29919 - DNA, 345 bp, Artificial Sequence; identical to SEQ ID NO: 29737
  Description of Artificial Sequence: Synthetic polynucleotide

SEQ ID NO: 29920 - protein, 115 aa, Artificial Sequence; identical to SEQ ID NO: 29738
  Description of Artificial Sequence: Synthetic polypeptide

SEQ ID NO: 29921 - DNA, 354 bp, Artificial Sequence; identical to SEQ ID NO: 29749
  Description of Artificial Sequence: Synthetic polynucleotide

SEQ ID NO: 29922 - protein, 118 aa, Artificial Sequence; identical to SEQ ID NO: 29750
  Description of Artificial Sequence: Synthetic polypeptide

SEQ ID NO: 29923 - DNA, 378 bp, Artificial Sequence
  Description of Artificial Sequence: Synthetic polynucleotide
caggtgcagctggtgcagtctggggctgaggtgaagaagcctggggcctcagtgaaggtctcctgtaaggcttctggatacaccttcaccagttatgatatcaactgggtgcgacaggccactggacaagggcttgagtggatgggatggatgaaccctaacagtggtaacacaggctatgcacagaagttccagggcagagtcaccatgacctggaacacctccaaaagcacagcctacatggagctgagcagcctgagatctgaggacacggccgtgtattactgtgcgagaggcttttacgatactttgactggttccggctactactacgttatggacgtctggggccaagggaccacggtcaccgtctcctca

SEQ ID NO: 29924 - protein, 126 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTWNTSKSTAYMELSSLRSEDTAVYYCARGFYDTLTGSGYYYVMDVWGQGTTVTVSS

SEQ ID NO: 29925 - DNA, 345 bp, Artificial Sequence; identical to SEQ ID NO: 29737
  Description of Artificial Sequence: Synthetic polynucleotide

SEQ ID NO: 29926 - protein, 115 aa, Artificial Sequence; identical to SEQ ID NO: 29738
  Description of Artificial Sequence: Synthetic polypeptide

SEQ ID NO: 29927 - DNA, 354 bp, Artificial Sequence; identical to SEQ ID NO: 29721
  Description of Artificial Sequence: Synthetic polynucleotide

SEQ ID NO: 29928 - protein, 118 aa, Artificial Sequence; identical to SEQ ID NO: 29722
  Description of Artificial Sequence: Synthetic polypeptide

SEQ ID NO: 29929 - DNA, 354 bp, Artificial Sequence; identical to SEQ ID NO: 29807
  Description of Artificial Sequence: Synthetic polynucleotide

SEQ ID NO: 29930 - protein, 118 aa, Artificial Sequence; identical to SEQ ID NO: 29808
  Description of Artificial Sequence: Synthetic polypeptide

SEQ ID NO: 29931 - DNA, 354 bp, Artificial Sequence; identical to SEQ ID NO: 29807
  Description of Artificial Sequence: Synthetic polynucleotide

SEQ ID NO: 29932 - protein, 118 aa, Artificial Sequence; identical to SEQ ID NO: 29808
  Description of Artificial Sequence: Synthetic polypeptide

SEQ ID NO: 29933 - DNA, 354 bp, Artificial Sequence; identical to SEQ ID NO: 29721
  Description of Artificial Sequence: Synthetic polynucleotide

SEQ ID NO: 29934 - protein, 118 aa, Artificial Sequence; identical to SEQ ID NO: 29722
  Description of Artificial Sequence: Synthetic polypeptide

SEQ ID NO: 29935 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgttactggagctggatccgccagcccccagggaaggggctggagtggattggggaaatcaatcatagtggaaggaccaactacaacccctccctcaagagtcgagtcaccatatcagtagacacgtccgagaaccagttctccctgaagctgagctctgtgaccgccgcggacacggctgtgtattactgtgcgagagactacggtgggcttgactactggggccagggaaccctggtcaccgtctcctca

SEQ ID NO: 29936 - protein, 115 aa, Artificial Sequence; identical to SEQ ID NO: 29790
  Description of Artificial Sequence: Synthetic polypeptide

SEQ ID NO: 29937 - DNA, 345 bp, Artificial Sequence; identical to SEQ ID NO: 29737
  Description of Artificial Sequence: Synthetic polynucleotide

SEQ ID NO: 29938 - protein, 115 aa, Artificial Sequence; identical to SEQ ID NO: 29738
  Description of Artificial Sequence: Synthetic polypeptide

SEQ ID NO: 29939 - DNA, 354 bp, Artificial Sequence; identical to SEQ ID NO: 29759
  Description of Artificial Sequence: Synthetic polynucleotide

SEQ ID NO: 29940 - protein, 118 aa, Artificial Sequence; identical to SEQ ID NO: 29760
  Description of Artificial Sequence: Synthetic polypeptide

SEQ ID NO: 29941 - DNA, 345 bp, Artificial Sequence
  Description of Artificial Sequence: Synthetic polynucleotide
caggtgcagctacagcagtggggcgcaggactgttgaagccttcggagaccctgtccctcacctgcactgtctatggtgggtccttcagtggttactactggagctggatccgccagcccccagggaaggggctggaatggattggggaaatcaatcatagtggaagcaccaacttcaacccgtccctcaagagtcgagtcaccatatcagtagacacgtccaagaaccagttctccctgaagctgagctctgtgaccgccgcggacacggctgtgttttactgtgcgagagactacggtgggcttgactactggggccagggaaccctggtcaccgtctcctca

SEQ ID NO: 29942 - protein, 115 aa, Artificial Sequence
  Description of Artificial Sequence: Synthetic polypeptide
QVQLQQWGAGLLKPSETLSLTCTVYGGSFSGYYWSWIRQPPGKGLEWIGEINHSGSTNFNPSLKSRVTISVDTSKNQFSLKLSSVTAADTAVFYCARDYGGLDYWGQGTLVTVSS

SEQ ID NO: 29943 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtacatctttgactactggggccagggaaccctggtcaccgtctcctca

SEQ ID NO: 29944 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAYSSGWYIFDYWGQGTLVTVSS

SEQ ID NO: 29945 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttccccaattatgatatcaactgggtgcgacaggccactggacaagggcttgagtggatgggatggatgaaccctaacagtggtaacacaggctatgcacagaagttccaggacagagtcaccatgaccaggaacacctccataagcacagcctacatggagctgagcagcctgagatctgaggacacggccgtgtattattgtgcggtttccagtggctggcactggttcgacccctggggccagggaaccctggtcaccgtcgcctca

SEQ ID NO: 29946 - protein, 118 aa, Artificial Sequence
  Description of Artificial Sequence: Synthetic polypeptide
QVQLVQSGAEVKKPGASVKVSCKASGYTFPNYDINWVRQATGQGLEWMGWMNPNSGNTGYAQKFQDRVTMTRNTSISTAYMELSSLRSEDTAVYYCAVSSGWHWFDPWGQGTLVTVAS

SEQ ID NO: 29947 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatggcagctatggttacgacggccttgactactggggccagggaaccctggtcgccgtctcctca

SEQ ID NO: 29948 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDGSYGYDGLDYWGQGTLVAVSS

SEQ ID NO: 29949 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttcctactggagctggatccgccagcccccagggaaggggctagagtggattggggaaatcaatcaaagtggacgcaccaactacaacccgtccctcaagagtcgagtcaccatatcagtagacacgtccaagaaccagttctccctgaagctgagctctgtgaccgccgcggacacggctgtgtattactgtgcgagagactacgggggtatagacgtctggggccaagggaccacggtcaccgtctcctca

SEQ ID NO: 29950 - protein, 115 aa, Artificial Sequence
  Description of Artificial Sequence: Synthetic polypeptide
QVQLQQWGAGLLKPSETLSLTCAVYGGSFSGSYWSWIRQPPGKGLEWIGEINQSGRTNYNPSLKSRVTISVDTSKNQFSLKLSSVTAADTAVYYCARDYGGIDVWGQGTTVTVSS

SEQ ID NO: 29951 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccctttatagtgggagctacttactttgactactggggccagggaaccctggtcaccgtctcctca

SEQ ID NO: 29952 - protein, 121 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARDPFIVGATYFDYWGQGTLVTVSS

SEQ ID NO: 29953 - DNA, 354 bp, Artificial Sequence; identical to SEQ ID NO: 29817
  Description of Artificial Sequence: Synthetic polynucleotide

SEQ ID NO: 29954 - protein, 118 aa, Artificial Sequence; identical to SEQ ID NO: 29818
  Description of Artificial Sequence: Synthetic polypeptide

SEQ ID NO: 29955 - DNA, 345 bp, Artificial Sequence; identical to SEQ ID NO: 29737
  Description of Artificial Sequence: Synthetic polynucleotide

SEQ ID NO: 29956 - protein, 115 aa, Artificial Sequence; identical to SEQ ID NO: 29738
  Description of Artificial Sequence: Synthetic polypeptide

SEQ ID NO: 29957 - DNA, 345 bp, Artificial Sequence; identical to SEQ ID NO: 29737
  Description of Artificial Sequence: Synthetic polynucleotide

SEQ ID NO: 29958 - protein, 115 aa, Artificial Sequence; identical to SEQ ID NO: 29738
  Description of Artificial Sequence: Synthetic polypeptide

SEQ ID NO: 29959 - DNA, 354 bp, Artificial Sequence; identical to SEQ ID NO: 29721
  Description of Artificial Sequence: Synthetic polynucleotide

SEQ ID NO: 29960 - protein, 118 aa, Artificial Sequence; identical to SEQ ID NO: 29722
  Description of Artificial Sequence: Synthetic polypeptide

SEQ ID NO: 29961 - DNA, 345 bp, Artificial Sequence; identical to SEQ ID NO: 29757
  Description of Artificial Sequence: Synthetic polynucleotide

SEQ ID NO: 29962 - protein, 115 aa, Artificial Sequence; identical to SEQ ID NO: 29758
  Description of Artificial Sequence: Synthetic polypeptide

SEQ ID NO: 29963 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtgattgctactggagctggatccgccagcccccagggaaggggctggagtggattggggaaatcaatcatagtggaaggaccaactacaacccgtccctcaagagtcgagtcaccatatcagtagacacgtccgagaaccagttctccctgaagctgagctctgtgaccgccgcggacacggctgtgtattactgtgcgagagactacggtgggcttgactactggggccagggaaccctggtcaccgtctcctca

SEQ ID NO: 29964 - protein, 115 aa, Artificial Sequence
  Description of Artificial Sequence: Synthetic polypeptide
QVQLQQWGAGLLKPSETLSLTCAVYGGSFSDCYWSWIRQPPGKGLEWIGEINHSGRTNYNPSLKSRVTISVDTSENQFSLKLSSVTAADTAVYYCARDYGGLDYWGQGTLVTVSS

SEQ ID NO: 29965 - DNA, 345 bp, Artificial Sequence; identical to SEQ ID NO: 29765
  Description of Artificial Sequence: Synthetic polynucleotide

SEQ ID NO: 29966 - protein, 115 aa, Artificial Sequence; identical to SEQ ID NO: 29766
  Description of Artificial Sequence: Synthetic polypeptide

SEQ ID NO: 29967 - DNA, 345 bp, Artificial Sequence; identical to SEQ ID NO: 29773
  Description of Artificial Sequence: Synthetic polynucleotide

SEQ ID NO: 29968 - protein, 115 aa, Artificial Sequence; identical to SEQ ID NO: 29774
  Description of Artificial Sequence: Synthetic polypeptide

SEQ ID NO: 29969 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttgaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggaactgagcagcctgagatctgaggacacggccgtgtattaccgtgggagtaccagtggctggaacttctttgactactggggccagggaaccctggtcaccgtctcctca

SEQ ID NO: 29970 - protein, 118 aa, Artificial Sequence
  Description of Artificial Sequence: Synthetic polypeptide
QVQLVQSGAEVKKPGASVKVSCKASGYTLTNYDINWVRQATGQGLEWMGWMNPNSGNTGYAQKFQGRVTMTRNTSISTAYMELSSLRSEDTAVYYRGSTSGWNFFDYWGQGTLVTVSS

SEQ ID NO: 29971 - DNA, 345 bp, Artificial Sequence
  Description of Artificial Sequence: Synthetic polynucleotide
caggtacagctacagcagcggggcgcaggactgttgaagccttcggagaccctgtccctcacctgcgctgtctatggtgggtccttcagtggttgttactggagctggatccgccagccccccgggaaggggctggagtggattggggaaatcaatcatagtggaatcaccaactacaacccgtccctcaagagtcgagtcaccatatcagtagacacgtccaagaaccagttctccctgaagctgacctctgtgaccgccgcggacacggctgtgtattactgtgcgagagactacggtggtttggacgtctggggccaagggaccacggtcaccgtctcctca

SEQ ID NO: 29972 - protein, 115 aa, Artificial Sequence
  Description of Artificial Sequence: Synthetic polypeptide
QVQLQQRGAGLLKPSETLSLTCAVYGGSFSGCYWSWIRQPPGKGLEWIGEINHSGITNYNPSLKSRVTISVDTSKNQFSLKLTSVTAADTAVYYCARDYGGLDVWGQGTTVTVSS

SEQ ID NO: 29973 - DNA, 354 bp, Artificial Sequence; identical to SEQ ID NO: 28201
  Description of Artificial Sequence: Synthetic polynucleotide

SEQ ID NO: 29974 - protein, 118 aa, Artificial Sequence; identical to SEQ ID NO: 28202
  Description of Artificial Sequence: Synthetic polypeptide

SEQ ID NO: 29975 - DNA, 354 bp, Artificial Sequence; identical to SEQ ID NO: 29721
  Description of Artificial Sequence: Synthetic polynucleotide

SEQ ID NO: 29976 - protein, 118 aa, Artificial Sequence; identical to SEQ ID NO: 29722
  Description of Artificial Sequence: Synthetic polypeptide

SEQ ID NO: 29977 - DNA, 345 bp, Artificial Sequence; identical to SEQ ID NO: 29737
  Description of Artificial Sequence: Synthetic polynucleotide

SEQ ID NO: 29978 - protein, 115 aa, Artificial Sequence; identical to SEQ ID NO: 29738
  Description of Artificial Sequence: Synthetic polypeptide

SEQ ID NO: 29979 - DNA, 345 bp, Artificial Sequence; identical to SEQ ID NO: 29737
  Description of Artificial Sequence: Synthetic polynucleotide

SEQ ID NO: 29980 - protein, 115 aa, Artificial Sequence; identical to SEQ ID NO: 29738
  Description of Artificial Sequence: Synthetic polypeptide

SEQ ID NO: 29981 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggagcacctccacaagcacagcccacatggagctgagcagcctgagatctgaggacacggccgtgtattactgtgcggtttccagtggctggtcctggttcgacccctggggccagggaaccctggtcaccgtctcctca

SEQ ID NO: 29982 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRSTSTSTAHMELSSLRSEDTAVYYCAVSSGWSWFDPWGQGTLVTVSS

SEQ ID NO: 29983 - DNA, 345 bp, Artificial Sequence; identical to SEQ ID NO: 29737
  Description of Artificial Sequence: Synthetic polynucleotide

SEQ ID NO: 29984 - protein, 115 aa, Artificial Sequence; identical to SEQ ID NO: 29738
  Description of Artificial Sequence: Synthetic polypeptide

SEQ ID NO: 29985 - DNA, 345 bp, Artificial Sequence
  Description of Artificial Sequence: Synthetic polynucleotide
caggtgcagctgcagccgtggggcgcaggactgttgaagccttcggagaccctgtccctcacctgcgctgtctatggtgggtccttcagtggttactactggagctggatccgccagcccccagggaaggggctggagtggattggggaaatcaatcatagtggacgcaccaactacaacccgtccctcaagagtcgagtcaccatatcagtagacacgtccaaggaccagttctccctgaagctgagctctgtgaccgccgcggacacggctgtgtattactgtgcgagagactacggtggtttggacgtctggggccaagggaccacggtcaccgtctcctca

SEQ ID NO: 29986 - protein, 115 aa, Artificial Sequence
  Description of Artificial Sequence: Synthetic polypeptide
QVQLQPWGAGLLKPSETLSLTCAVYGGSFSGYYWSWIRQPPGKGLEWIGEINHSGRTNYNPSLKSRVTISVDTSKDQFSLKLSSVTAADTAVYYCARDYGGLDVWGQGTTVTVSS

SEQ ID NO: 29987 - DNA, 345 bp, Artificial Sequence; identical to SEQ ID NO: 29737
  Description of Artificial Sequence: Synthetic polynucleotide

SEQ ID NO: 29988 - protein, 115 aa, Artificial Sequence; identical to SEQ ID NO: 29738
  Description of Artificial Sequence: Synthetic polypeptide

SEQ ID NO: 29989 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagattttggagtgggctactacggtatggacgtctggggccaagggaccacggtcaccgtctcctca

SEQ ID NO: 29990 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDFGVGYYGMDVWGQGTTVTVSS

SEQ ID NO: 29991 - DNA, 345 bp, Artificial Sequence; identical to SEQ ID NO: 29737
  Description of Artificial Sequence: Synthetic polynucleotide

SEQ ID NO: 29992 - protein, 115 aa, Artificial Sequence; identical to SEQ ID NO: 29738
  Description of Artificial Sequence: Synthetic polypeptide

SEQ ID NO: 29993 - DNA, 354 bp, Artificial Sequence; identical to SEQ ID NO: 29749
  Description of Artificial Sequence: Synthetic polynucleotide

SEQ ID NO: 29994 - protein, 118 aa, Artificial Sequence; identical to SEQ ID NO: 29750
  Description of Artificial Sequence: Synthetic polypeptide

SEQ ID NO: 29995 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcctatagcagtggctggtacttctttgactactggggccagggaaccctggtcaccgtctcctca

SEQ ID NO: 29996 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAYSSGWYFFDYWGQGTLVTVSS

SEQ ID NO: 29997 - DNA, 345 bp, Artificial Sequence; identical to SEQ ID NO: 29737
  Description of Artificial Sequence: Synthetic polynucleotide

SEQ ID NO: 29998 - protein, 115 aa, Artificial Sequence; identical to SEQ ID NO: 29738
  Description of Artificial Sequence: Synthetic polypeptide

SEQ ID NO: 29999 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtactactttgactactggggccagggaaccctggtcaccgtctcctca

SEQ ID NO: 30000 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAYSSGWYYFDYWGQGTLVTVSS

SEQ ID NO: 30001 - DNA, 345 bp, Artificial Sequence; identical to SEQ ID NO: 29737
  Description of Artificial Sequence: Synthetic polynucleotide

SEQ ID NO: 30002 - protein, 115 aa, Artificial Sequence; identical to SEQ ID NO: 29738
  Description of Artificial Sequence: Synthetic polypeptide

SEQ ID NO: 30003 - DNA, 354 bp, Artificial Sequence; identical to SEQ ID NO: 29807
  Description of Artificial Sequence: Synthetic polynucleotide

SEQ ID NO: 30004 - protein, 118 aa, Artificial Sequence; identical to SEQ ID NO: 29808
  Description of Artificial Sequence: Synthetic polypeptide

SEQ ID NO: 30005 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtgacacaggctatgcacagaagttccagggcagtgtcaccatgaccaggaacacctccataaccacagcctacatggagctgagcagcctgagatctgaggacacggccgtgtattactgttcgtatagcagtggctggtactactttgactactggggccagggaaccctggtcaccgtctcctca

SEQ ID NO: 30006 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGDTGYAQKFQGSVTMTRNTSITTAYMELSSLRSEDTAVYYCSYSSGWYYFDYWGQGTLVTVSS

SEQ ID NO: 30007 - DNA, 387 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgacctggaacacctccatacgcactgcctacatggagctgagcagcctgagatctgaggacacggccgtgtattactgtgcgcgagggttttacgattttttgactggttattcccccacctactactactacgatatggacgtctggggccaagggaccacggtcaccgtctcctca

SEQ ID NO: 30008 - protein, 129 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTWNTSIRTAYMELSSLRSEDTAVYYCARGFYDFLTGYSPTYYYYDMDVWGQGTTVTVSS

SEQ ID NO: 30009 - DNA, 345 bp, Artificial Sequence; identical to SEQ ID NO: 29737
  Description of Artificial Sequence: Synthetic polynucleotide

SEQ ID NO: 30010 - protein, 115 aa, Artificial Sequence; identical to SEQ ID NO: 29738
  Description of Artificial Sequence: Synthetic polypeptide

SEQ ID NO: 30011 - DNA, 345 bp, Artificial Sequence; identical to SEQ ID NO: 29737
  Description of Artificial Sequence: Synthetic polynucleotide

SEQ ID NO: 30012 - protein, 115 aa, Artificial Sequence; identical to SEQ ID NO: 29738
  Description of Artificial Sequence: Synthetic polypeptide

SEQ ID NO: 30013 - DNA, 345 bp, Artificial Sequence; identical to SEQ ID NO: 29737
  Description of Artificial Sequence: Synthetic polynucleotide

SEQ ID NO: 30014 - protein, 115 aa, Artificial Sequence; identical to SEQ ID NO: 29738
  Description of Artificial Sequence: Synthetic polypeptide

SEQ ID NO: 30015 - DNA, 354 bp, Artificial Sequence
  Description of Artificial Sequence: Synthetic polynucleotide
caggtgcagctggtgcagtctggggctgaggtgaagaagcctggggcctcagtgagggtctcctgcaaggcttctggatacaccttcagcaattatgatatcaactgggtgcgacaggccactggacaagggcttgagtggatgggatggatgacccctaacagtggtaacacaggctatgcacagaagttccagggcagagtcaccatgaccaggaacacctccataagcacagcctacatggagctgagcagcctgagatctgaggacacggccgtgtattactgtgcgagtagcagtggctggtactactttgactcctggggccagggaaccctggtcaccgtctcctta

SEQ ID NO: 30016 - protein, 118 aa, Artificial Sequence
  Description of Artificial Sequence: Synthetic polypeptide
QVQLVQSGAEVKKPGASVRVSCKASGYTFSNYDINWVRQATGQGLEWMGWMTPNSGNTGYAQKFQGRVTMTRNTSISTAYMELSSLRSEDTAVYYCASSSGWYYFDSWGQGTLVTVSL

SEQ ID NO: 30017 - DNA, 345 bp, Artificial Sequence; identical to SEQ ID NO: 29737
  Description of Artificial Sequence: Synthetic polynucleotide

SEQ ID NO: 30018 - protein, 115 aa, Artificial Sequence; identical to SEQ ID NO: 29738
  Description of Artificial Sequence: Synthetic polypeptide

SEQ ID NO: 30019 - DNA, 375 bp, Artificial Sequence
  Description of Artificial Sequence: Synthetic polynucleotide
gaggtgcagctggtggagtctgggggaggcttggtacagccgggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtatttctgtgcaagagctcttgactacggtgactccttgggctactactactacggtatggacgtctggggccaagggaccacggtcaccgtctcctca

SEQ ID NO: 30020 - protein, 125 aa, Artificial Sequence
  Description of Artificial Sequence: Synthetic polypeptide
EVQLVESGGGLVQPGGSLRLSCAASGFTFSSYDMHWVRQATGKGLEWVSAIGTAGDTYYPGSVKGRFTISRENAKNSLYLQMNSLRAGDTAVYFCARALDYGDSLGYYYYGMDVWGQGTTVTVSS

SEQ ID NO: 30021 - DNA, 345 bp, Artificial Sequence; identical to SEQ ID NO: 29737
  Description of Artificial Sequence: Synthetic polynucleotide

SEQ ID NO: 30022 - protein, 115 aa, Artificial Sequence; identical to SEQ ID NO: 29738
  Description of Artificial Sequence: Synthetic polypeptide

SEQ ID NO: 30023 - DNA, 345 bp, Artificial Sequence
  Description of Artificial Sequence: Synthetic polynucleotide
caggtgcagctacaacagtggggcgcaggactgttgaagccttcggagaccctgtccctcacttgcgctgtctatggtgggtccttcagtggttgctactggagctggatccgccagcccccagggaaggggctggagtggattggggaaatcaattatagtggaagcaccaacttcaacccgtccctcaagagtcgagtcaccatatcagctgacacgtccaagaaccagttctccctgaagctgagctctgtgaccgccgcggacacggctgtgtattactgtgcgagagactacggcggtatggacgtctggggccaagggaccacggtcaccgtctcctca

SEQ ID NO: 30024 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINYSGSTNFNPSLKSRVTISADTSKNQFSLKLSSVTAADTAVYYCARDYGGMDVWGQGTTVTVSS

SEQ ID NO: 30025 - DNA, 345 bp, Artificial Sequence; identical to SEQ ID NO: 29737
  Description of Artificial Sequence: Synthetic polynucleotide

SEQ ID NO: 30026 - protein, 115 aa, Artificial Sequence; identical to SEQ ID NO: 29738
  Description of Artificial Sequence: Synthetic polypeptide

SEQ ID NO: 30027 - DNA, 345 bp, Artificial Sequence
  Description of Artificial Sequence: Synthetic polynucleotide
caggtgcagctgcagccgtggggcgcaggactgttgaagccttcggagaccctgtccctcacctgcgctgtctatggtgggtccttcagtggttactactggagctggatccgccagcccccagggaaggggctggagtggattggggaaatcaatcatagtggacgcaccagctacaacccgtccctcaagagtcgagtcaccatatcagtagacacgtccaagaaccagttctccctgaagctgagctctgtgaccgccgcggacacggctgtgtattactgtgcgagagactacggtggtttggacgtctggggccaagggaccacggtcaccgtctcctca

SEQ ID NO: 30028 - protein, 115 aa, Artificial Sequence
  Description of Artificial Sequence: Synthetic polypeptide
QVQLQPWGAGLLKPSETLSLTCAVYGGSFSGYYWSWIRQPPGKGLEWIGEINHSGRTSYNPSLKSRVTISVDTSKNQFSLKLSSVTAADTAVYYCARDYGGLDVWGQGTTVTVSS

SEQ ID NO: 30029 - DNA, 345 bp, Artificial Sequence; identical to SEQ ID NO: 29737
  Description of Artificial Sequence: Synthetic polynucleotide

SEQ ID NO: 30030 - protein, 115 aa, Artificial Sequence; identical to SEQ ID NO: 29738
  Description of Artificial Sequence: Synthetic polypeptide

SEQ ID NO: 30031 - DNA, 345 bp, Artificial Sequence; identical to SEQ ID NO: 29737
  Description of Artificial Sequence: Synthetic polynucleotide

SEQ ID NO: 30032 - protein, 115 aa, Artificial Sequence; identical to SEQ ID NO: 29738
  Description of Artificial Sequence: Synthetic polypeptide

SEQ ID NO: 30033 - DNA, 345 bp, Artificial Sequence; identical to SEQ ID NO: 29737
  Description of Artificial Sequence: Synthetic polynucleotide

SEQ ID NO: 30034 - protein, 115 aa, Artificial Sequence; identical to SEQ ID NO: 29738
  Description of Artificial Sequence: Synthetic polypeptide

SEQ ID NO: 30035 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccagtctccaggcaaggggctggagtgggtggcagttatatggtatgaaggaagtaatacatactatgcagactccgtgaagggccgattcaccatctccagagacaattccaagaacacgctgtatctgcaaatgaacagcctgagagccgaggacacggctgtatattactgtgtgagagagatggggtggttagatgactactggggccagggaaccctggtcaccgtctcctca

SEQ ID NO: 30036 - protein, 117 aa, Artificial Sequence
  Description of Artificial Sequence: Synthetic polypeptide
QVQLVESGGGVVQPGRSLRLSCAASGFTFSDYGMHWVRQSPGKGLEWVAVIWYEGSNTYYADSVKGRFTISRDNSKNTLYLQMNSLRAEDTAVYYCVREMGWLDDYWGQGTLVTVSS

SEQ ID NO: 30037 - DNA, 354 bp, Artificial Sequence; identical to SEQ ID NO: 29759
  Description of Artificial Sequence: Synthetic polynucleotide

SEQ ID NO: 30038 - protein, 118 aa, Artificial Sequence; identical to SEQ ID NO: 29760
  Description of Artificial Sequence: Synthetic polypeptide

SEQ ID NO: 30039 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcctatagcagtggctggtacatctttgactactggggccagggaaccctggtcaccgtctcctca

SEQ ID NO: 30040 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYIFDYWGQGTLVTVSS

SEQ ID NO: 30041 - DNA, 345 bp, Artificial Sequence; identical to SEQ ID NO: 29737
  Description of Artificial Sequence: Synthetic polynucleotide

SEQ ID NO: 30042 - protein, 115 aa, Artificial Sequence; identical to SEQ ID NO: 29738
  Description of Artificial Sequence: Synthetic polypeptide

SEQ ID NO: 30043 - DNA, 375 bp, Artificial Sequence; identical to SEQ ID NO: 29783
  Description of Artificial Sequence: Synthetic polynucleotide

SEQ ID NO: 30044 - protein, 125 aa, Artificial Sequence; identical to SEQ ID NO: 29784
  Description of Artificial Sequence: Synthetic polypeptide

SEQ ID NO: 30045 - DNA, 354 bp, Artificial Sequence; identical to SEQ ID NO: 29807
  Description of Artificial Sequence: Synthetic polynucleotide

SEQ ID NO: 30046 - protein, 118 aa, Artificial Sequence; identical to SEQ ID NO: 29808
  Description of Artificial Sequence: Synthetic polypeptide

SEQ ID NO: 30047 - DNA, 345 bp, Artificial Sequence; identical to SEQ ID NO: 29737
  Description of Artificial Sequence: Synthetic polynucleotide

SEQ ID NO: 30048 - protein, 115 aa, Artificial Sequence; identical to SEQ ID NO: 29738
  Description of Artificial Sequence: Synthetic polypeptide

SEQ ID NO: 30049 - DNA, 345 bp, Artificial Sequence; identical to SEQ ID NO: 29737
  Description of Artificial Sequence: Synthetic polynucleotide

SEQ ID NO: 30050 - protein, 115 aa, Artificial Sequence; identical to SEQ ID NO: 29738
  Description of Artificial Sequence: Synthetic polypeptide

SEQ ID NO: 30051 - DNA, 345 bp, Artificial Sequence; identical to SEQ ID NO: 29737
  Description of Artificial Sequence: Synthetic polynucleotide

SEQ ID NO: 30052 - protein, 115 aa, Artificial Sequence; identical to SEQ ID NO: 29738
  Description of Artificial Sequence: Synthetic polypeptide

SEQ ID NO: 30053 - DNA, 345 bp, Artificial Sequence; identical to SEQ ID NO: 29737
  Description of Artificial Sequence: Synthetic polynucleotide

SEQ ID NO: 30054 - protein, 115 aa, Artificial Sequence; identical to SEQ ID NO: 29738
  Description of Artificial Sequence: Synthetic polypeptide

SEQ ID NO: 30055 - DNA, 354 bp, Artificial Sequence; identical to SEQ ID NO: 29807
  Description of Artificial Sequence: Synthetic polynucleotide

SEQ ID NO: 30056 - protein, 118 aa, Artificial Sequence; identical to SEQ ID NO: 29808
  Description of Artificial Sequence: Synthetic polypeptide

SEQ ID NO: 30057 - DNA, 345 bp, Artificial Sequence; identical to SEQ ID NO: 29737
  Description of Artificial Sequence: Synthetic polynucleotide

SEQ ID NO: 30058 - protein, 115 aa, Artificial Sequence; identical to SEQ ID NO: 29738
  Description of Artificial Sequence: Synthetic polypeptide

SEQ ID NO: 30059 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttcctactggagctggatccgccagcccccagggaaggggctggagtggattggggaaatcaattataggggaagcaccaactacaacccgtccctcaagagtcgagtcgccatatcagtagacacgtccaagaaccagttctccctgaacctgacctctgtgaccgccgcggacacggctgtgtattactgtgcgagggactacggcggtttggacgtctggggccaagggaccacggtcaccgtctcctca

SEQ ID NO: 30060 - protein, 115 aa, Artificial Sequence
  Description of Artificial Sequence: Synthetic polypeptide
QVQLQQWGAGLLKPSETLSLTCAVYGGSFSGSYWSWIRQPPGKGLEWIGEINYRGSTNYNPSLKSRVAISVDTSKNQFSLNLTSVTAADTAVYYCARDYGGLDVWGQGTTVTVSS

SEQ ID NO: 30061 - DNA, 375 bp, Artificial Sequence
  Description of Artificial Sequence: Synthetic polynucleotide
gaggtgcagctggtggagtctgggggaggcttggtacagccgggggggtccctgagactctcctgtgcagcctctggattcaccttcagtaactacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtatttctgtgcaagagctcttgactacggtgactccttgggctactactactacggtatggacgtctggggccaagggaccacggtcaccgtctcctca

SEQ ID NO: 30062 - protein, 125 aa, Artificial Sequence
  Description of Artificial Sequence: Synthetic polypeptide
EVQLVESGGGLVQPGGSLRLSCAASGFTFSNYDMHWVRQATGKGLEWVSAIGTAGDTYYPGSVKGRFTISRENAKNSLYLQMNSLRAGDTAVYFCARALDYGDSLGYYYYGMDVWGQGTTVTVSS

SEQ ID NO: 30063 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccctttatagtgggagctacttactttgactactggggccagggaaccctggtcaccgtctcctca

SEQ ID NO: 30064 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPFIVGATYFDYWGQGTLVTVSS

SEQ ID NO: 30065 - DNA, 345 bp, Artificial Sequence; identical to SEQ ID NO: 29737
  Description of Artificial Sequence: Synthetic polynucleotide

SEQ ID NO: 30066 - protein, 115 aa, Artificial Sequence; identical to SEQ ID NO: 29738
  Description of Artificial Sequence: Synthetic polypeptide

SEQ ID NO: 30067 - DNA, 354 bp, Artificial Sequence
  Description of Artificial Sequence: Synthetic polynucleotide
caggtgcagctggtgcagtctggggctgaggtgaagaaacctggggcctcagtgagggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccatgagcacagcctacatggagctgagcagcctgagatctgaggacacggccgtgtattactgtgcccatagcagtggctggtacttttttgactactggggccagggaaccctggtcaccgtctcctca

SEQ ID NO: 30068 - protein, 118 aa, Artificial Sequence
  Description of Artificial Sequence: Synthetic polypeptide
QVQLVQSGAEVKKPGASVRVSCKASGYTFTNYDINWVRQATGQGLEWMGWMHPNSGNTGYAQKFQGRVTMTRNTSMSTAYMELSSLRSEDTAVYYCAHSSGWYFFDYWGQGTLVTVSS

SEQ ID NO: 30069 - DNA, 345 bp, Artificial Sequence; identical to SEQ ID NO: 29737
  Description of Artificial Sequence: Synthetic polynucleotide

SEQ ID NO: 30070 - protein, 115 aa, Artificial Sequence; identical to SEQ ID NO: 29738
  Description of Artificial Sequence: Synthetic polypeptide

SEQ ID NO: 30071 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttgaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggaactgagcagcctgagatctgaggacacggccgtgtattaccgtgggagtaccagtggcgggaagttcttcgactactggggccagggaaccctggtcaccgtctcctca

SEQ ID NO: 30072 - protein, 118 aa, Artificial Sequence
  Description of Artificial Sequence: Synthetic polypeptide
QVQLVQSGAEVKKPGASVKVSCKASGYTLTNYDINWVRQATGQGLEWMGWMNPNSGNTGYAQKFQGRVTMTRNTSISTAYMELSSLRSEDTAVYYRGSTSGGKFFDYWGQGTLVTVSS

SEQ ID NO: 30073 - DNA, 345 bp, Artificial Sequence; identical to SEQ ID NO: 29737
  Description of Artificial Sequence: Synthetic polynucleotide

SEQ ID NO: 30074 - protein, 115 aa, Artificial Sequence; identical to SEQ ID NO: 29738
  Description of Artificial Sequence: Synthetic polypeptide

SEQ ID NO: 30075 - DNA, 345 bp, Artificial Sequence; identical to SEQ ID NO: 29737
  Description of Artificial Sequence: Synthetic polynucleotide

SEQ ID NO: 30076 - protein, 115 aa, Artificial Sequence; identical to SEQ ID NO: 29738
  Description of Artificial Sequence: Synthetic polypeptide

SEQ ID NO: 30077 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgctactggagctggatccgccagcccccagggaaggggctggagtggattggggaaatcaatcatagtggaaggaccaactacaacccgtccctcaagagtcgagtcaccatatcagtagacacgtccgagaacaagttctccctgaagctgagctctgtgaccgccgcggacacggctgtgtattactgtgcgagagactacggtgggcttgactactggggccagggaaccctggtcaccgtctcctca

SEQ ID NO: 30078 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINHSGRTNYNPSLKSRVTISVDTSENKFSLKLSSVTAADTAVYYCARDYGGLDYWGQGTLVTVSS

SEQ ID NO: 30079 - DNA, 345 bp, Artificial Sequence; identical to SEQ ID NO: 29757
  Description of Artificial Sequence: Synthetic polynucleotide

SEQ ID NO: 30080 - protein, 115 aa, Artificial Sequence; identical to SEQ ID NO: 29758
  Description of Artificial Sequence: Synthetic polypeptide

SEQ ID NO: 30081 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaacgatatcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaattaacagcctgagagccgaggacacggctgtgtatttctgtgcgagagaaaaatatagcagtggctggtacgactacggtatggacgtctggggccaagggaccacggtcaccgtctcctca

SEQ ID NO: 30082 - protein, 123 aa, Artificial Sequence
  Description of Artificial Sequence: Synthetic polypeptide
QVQLVESGGGVVQPGRSLRLSCAASGFTFSNDIMHWVRQAPGKGLEWVAVIWYDGSNKYYADSVKGRFTISRDNSKNTLYLQINSLRAEDTAVYFCAREKYSSGWYDYGMDVWGQGTTVTVSS

SEQ ID NO: 30083 - DNA, 354 bp, Artificial Sequence; identical to SEQ ID NO: 29945
  Description of Artificial Sequence: Synthetic polynucleotide

SEQ ID NO: 30084 - protein, 118 aa, Artificial Sequence; identical to SEQ ID NO: 29946
  Description of Artificial Sequence: Synthetic polypeptide

SEQ ID NO: 30085 - DNA, 354 bp, Artificial Sequence; identical to SEQ ID NO: 29999
  Description of Artificial Sequence: Synthetic polynucleotide

SEQ ID NO: 30086 - protein, 118 aa, Artificial Sequence; identical to SEQ ID NO: 30000
  Description of Artificial Sequence: Synthetic polypeptide

SEQ ID NO: 30087 - DNA, 354 bp, Artificial Sequence
  Description of Artificial Sequence: Synthetic polynucleotide
caggtgcagttggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccacaagcacagcccacatggagctgagcagcctgagatctgaggacacggccgtgtattactgtgcggtctccagtggctggaagtggttcgacccctggggccagggaaccctggtcaccgtctcctca

SEQ ID NO: 30088 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSTSTAHMELSSLRSEDTAVYYCAVSSGWKWFDPWGQGTLVTVSS

SEQ ID NO: 30089 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttgaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggaactgagcagcctgagatctgaggacacggccgtgtattaccgtgggagtaccagtggctggaagttctttgactactggggccagggaaccctggtcaccgtctcctca

SEQ ID NO: 30090 - protein, 118 aa, Artificial Sequence
  Description of Artificial Sequence: Synthetic polypeptide
QVQLVQSGAEVKKPGASVKVSCKASGYTLTNYDINWVRQATGQGLEWMGWMNPNSGNTGYAQKFQGRVTMTRNTSISTAYMELSSLRSEDTAVYYRGSTSGWKFFDYWGQGTLVTVSS

SEQ ID NO: 30091 - DNA, 345 bp, Artificial Sequence; identical to SEQ ID NO: 29737
  Description of Artificial Sequence: Synthetic polynucleotide

SEQ ID NO: 30092 - protein, 115 aa, Artificial Sequence; identical to SEQ ID NO: 29738
  Description of Artificial Sequence: Synthetic polypeptide

SEQ ID NO: 30093 - DNA, 345 bp, Artificial Sequence; identical to SEQ ID NO: 29737
  Description of Artificial Sequence: Synthetic polynucleotide

SEQ ID NO: 30094 - protein, 115 aa, Artificial Sequence; identical to SEQ ID NO: 29738
  Description of Artificial Sequence: Synthetic polypeptide

SEQ ID NO: 30095 - DNA, 363 bp, Artificial Sequence; identical to SEQ ID NO: 29849
  Description of Artificial Sequence: Synthetic polynucleotide

SEQ ID NO: 30096 - protein, 121 aa, Artificial Sequence; identical to SEQ ID NO: 29850
  Description of Artificial Sequence: Synthetic polypeptide

SEQ ID NO: 30097 - DNA, 354 bp, Artificial Sequence; identical to SEQ ID NO: 28125
  Description of Artificial Sequence: Synthetic polynucleotide

SEQ ID NO: 30098 - protein, 118 aa, Artificial Sequence; identical to SEQ ID NO: 28126
  Description of Artificial Sequence: Synthetic polypeptide

SEQ ID NO: 30099 - DNA, 345 bp, Artificial Sequence; identical to SEQ ID NO: 29737
  Description of Artificial Sequence: Synthetic polynucleotide

SEQ ID NO: 30100 - protein, 115 aa, Artificial Sequence; identical to SEQ ID NO: 29738
  Description of Artificial Sequence: Synthetic polypeptide

SEQ ID NO: 30101 - DNA, 345 bp, Artificial Sequence; identical to SEQ ID NO: 29737
  Description of Artificial Sequence: Synthetic polynucleotide

SEQ ID NO: 30102 - protein, 115 aa, Artificial Sequence; identical to SEQ ID NO: 29738
  Description of Artificial Sequence: Synthetic polypeptide

SEQ ID NO: 30103 - DNA, 345 bp, Artificial Sequence; identical to SEQ ID NO: 29737
  Description of Artificial Sequence: Synthetic polynucleotide

SEQ ID NO: 30104 - protein, 115 aa, Artificial Sequence; identical to SEQ ID NO: 29738
  Description of Artificial Sequence: Synthetic polypeptide

SEQ ID NO: 30105 - DNA, 354 bp, Artificial Sequence; identical to SEQ ID NO: 29725
  Description of Artificial Sequence: Synthetic polynucleotide

SEQ ID NO: 30106 - protein, 118 aa, Artificial Sequence; identical to SEQ ID NO: 29726
  Description of Artificial Sequence: Synthetic polypeptide

SEQ ID NO: 30107 - DNA, 354 bp, Artificial Sequence; identical to SEQ ID NO: 29749
  Description of Artificial Sequence: Synthetic polynucleotide

SEQ ID NO: 30108 - protein, 118 aa, Artificial Sequence; identical to SEQ ID NO: 29750
  Description of Artificial Sequence: Synthetic polypeptide

SEQ ID NO: 30109 - DNA, 354 bp, Artificial Sequence; identical to SEQ ID NO: 29817
  Description of Artificial Sequence: Synthetic polynucleotide

SEQ ID NO: 30110 - protein, 118 aa, Artificial Sequence; identical to SEQ ID NO: 29818
  Description of Artificial Sequence: Synthetic polypeptide

SEQ ID NO: 30111 - DNA, 357 bp, Artificial Sequence; identical to SEQ ID NO: 29731
  Description of Artificial Sequence: Synthetic polynucleotide

SEQ ID NO: 30112 - protein, 119 aa, Artificial Sequence; identical to SEQ ID NO: 29732
  Description of Artificial Sequence: Synthetic polypeptide

SEQ ID NO: 30113 - DNA, 378 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacacgggcttgagtggatgggatggatgaaccctaacagtggtaacacaggctatgcacagaagttccagggcagagtcaccatgacctggaacacctccaaaagcacagcctacatggagctgagtagcctgagatctgaggacacggccgtgtattactgtgcgagaggcttttacgatactttgactggttccggctactactacgttatggacgtctggggccaagggaccacggtcaccgtctcctca

SEQ ID NO: 30114 - protein, 126 aa, Artificial Sequence
  Description of Artificial Sequence: Synthetic polypeptide
QVQLVQSGAEVKKPGASVKVSCKASGYTFTSYDINWVRQATGHGLEWMGWMNPNSGNTGYAQKFQGRVTMTWNTSKSTAYMELSSLRSEDTAVYYCARGFYDTLTGSGYYYVMDVWGQGTTVTVSS

SEQ ID NO: 30115 - DNA, 354 bp, Artificial Sequence; identical to SEQ ID NO: 29981
  Description of Artificial Sequence: Synthetic polynucleotide

SEQ ID NO: 30116 - protein, 118 aa, Artificial Sequence; identical to SEQ ID NO: 29982
  Description of Artificial Sequence: Synthetic polypeptide

SEQ ID NO: 30117 - DNA, 354 bp, Artificial Sequence; identical to SEQ ID NO: 28201
  Description of Artificial Sequence: Synthetic polynucleotide

SEQ ID NO: 30118 - protein, 118 aa, Artificial Sequence; identical to SEQ ID NO: 28202
  Description of Artificial Sequence: Synthetic polypeptide

SEQ ID NO: 30119 - DNA, 378 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgtcaggccactggacaagggcttgagtggatgggatggatgaaccctaacagtcgtaacacaggctatgcacagaagttccagggcagagtcaccatgacctggaacacctccataagcacagcctacatggagctgagcagcctgagatctgaggacacggccgtgtattactgtgcgagaggcggctacgatgttttgcctgggaataactactactacgatatggacgtctggggccaagggaccacggtcaccgtctcctca

SEQ ID NO: 30120 - protein, 126 aa, Artificial Sequence
  Description of Artificial Sequence: Synthetic polypeptide
QVQLVQSGAEVKKPGASVKVSCKASGYTFTSYDINWVRQATGQGLEWMGWMNPNSRNTGYAQKFQGRVTMTWNTSISTAYMELSSLRSEDTAVYYCARGGYDVLPGNNYYYDMDVWGQGTTVTVSS

SEQ ID NO: 30121 - DNA, 354 bp, Artificial Sequence; identical to SEQ ID NO: 30067
  Description of Artificial Sequence: Synthetic polynucleotide

SEQ ID NO: 30122 - protein, 118 aa, Artificial Sequence; identical to SEQ ID NO: 30068
  Description of Artificial Sequence: Synthetic polypeptide

SEQ ID NO: 30123 - DNA, 345 bp, Artificial Sequence; identical to SEQ ID NO: 29737
  Description of Artificial Sequence: Synthetic polynucleotide

SEQ ID NO: 30124 - protein, 115 aa, Artificial Sequence; identical to SEQ ID NO: 29738
  Description of Artificial Sequence: Synthetic polypeptide

SEQ ID NO: 30125 - DNA, 354 bp, Artificial Sequence; identical to SEQ ID NO: 29807
  Description of Artificial Sequence: Synthetic polynucleotide

SEQ ID NO: 30126 - protein, 118 aa, Artificial Sequence; identical to SEQ ID NO: 29808
  Description of Artificial Sequence: Synthetic polypeptide

SEQ ID NO: 30127 - DNA, 345 bp, Artificial Sequence; identical to SEQ ID NO: 29737
  Description of Artificial Sequence: Synthetic polynucleotide

SEQ ID NO: 30128 - protein, 115 aa, Artificial Sequence; identical to SEQ ID NO: 29738
  Description of Artificial Sequence: Synthetic polypeptide

SEQ ID NO: 30129 - DNA, 366 bp, Artificial Sequence
  Description of Artificial Sequence: Synthetic polynucleotide
caggtgcagctggtggagtctgggggaggcgtggtccagcctgggaggtccctgagactctcctgtgaagcgtctggaatcaccttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtttctgcaaatgaacagcctgagagccgaggacacggctgtgtattactgtgcgagagatcgtttagtgggagctaccgctgatgcttttgatatctggggccaagggacaatggtcaccgtctcttca

SEQ ID NO: 30130 - protein, 122 aa, Artificial Sequence
  Description of Artificial Sequence: Synthetic polypeptide
QVQLVESGGGVVQPGRSLRLSCEASGITFSSYGMHWVRQAPGKGLEWVAIIWYDGSNKYYADSVKGRFTISRDNSKNTLFLQMNSLRAEDTAVYYCARDRLVGATADAFDIWGQGTMVTVSS

SEQ ID NO: 30131 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaaggggctggagtggattgggagtatatattatagtgggagtacctcctacaacccgtccctcaagagtcgagtcaccatatccgtcgacacgtccaagaaccagttctccctgaagctgagctctgtgaccgccgcagacacggctgtttattactgtgcgagacttgatctcctgtggagttttgactactggggccagggaaccctggtcaccgtctcctca

SEQ ID NO: 30132 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGSIYYSGSTSYNPSLKSRVTISVDTSKNQFSLKLSSVTAADTAVYYCARLDLLWSFDYWGQGTLVTVSS

SEQ ID NO: 30133 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccggttcaccatctccagagacaattccaagaacacactatatctgcaaatgaacagcctgagagccgaggacacggccgtatattactgtgcgaaacgggtgacggactacggtggtaacgactggttcgacccctggggccagggaaccctggtcaccgtctcctca

SEQ ID NO: 30134 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGNTFYADSVKGRFTISRDNSKNTLYLQMNSLRAEDTAVYYCAKRVTDYGGNDWFDPWGQGTLVTVSS

SEQ ID NO: 30135 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagttataaatactatgcagactccgtgaagggccgattcaccatctccagagacaattccaagaacacgctggatctgcaaatgaacagcctgagagccgaggacacggctgtgtattactgtgtgaaaatgggtatagaagtggctgtggactactactacggtatggacgtctggggccaagggaccacggtcaccgtctcctca

SEQ ID NO: 30136 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSYKYYADSVKGRFTISRDNSKNTLDLQMNSLRAEDTAVYYCVKMGIEVAVDYYYGMDVWGQGTTVTVSS

SEQ ID NO: 30137 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatgggtgcaccctaacagtggtaacacaggctatgcacagaagttccagggcagagtcaccatgaccaggaacacctccataagcacagcctacatggagctgagcagcctgagatctgaggacacggccgtgtattactgtgcggggagcagtggctggtactactttgactactggggccagggaaccctggtcaccgtctcctca

SEQ ID NO: 30138 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWVHPNSGNTGYAQKFQGRVTMTRNTSISTAYMELSSLRSEDTAVYYCAGSSGWYYFDYWGQGTLVTVSS

SEQ ID NO: 30139 - DNA, 363 bp, Artificial Sequence
  Description of Artificial Sequence: Synthetic polynucleotide
caggtgcagctgcaggagtcgggcccaggactggtgaagccttcacagaccctgtccctcaattgcactgtctctggtggctccatcagcaacagtggttactactggagctggatccgccagcacccagggaagggcctggaatggattgggtacagctattacagtgggagcacctactacaacccgtccctcaagagtcgaattaccatatcagtagacacgtctaacaaccagttctccctgaagctgacctctgtgactgccgcggacacggccgtgtattactgtgcgagagggaaatataactggaaccatgcttttgatatctggggccaagggacaatggtcaccgtctcttca

SEQ ID NO: 30140 - protein, 121 aa, Artificial Sequence
  Description of Artificial Sequence: Synthetic polypeptide
QVQLQESGPGLVKPSQTLSLNCTVSGGSISNSGYYWSWIRQHPGKGLEWIGYSYYSGSTYYNPSLKSRITISVDTSNNQFSLKLTSVTAADTAVYYCARGKYNWNHAFDIWGQGTMVTVSS

SEQ ID NO: 30141 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttaacagctatgccatgaactgggtccgccaggctccagggaaggggctggagtgggtctcagctattagtggtagtggtggtaacacattctacgcagactccgtgaagggccgcttcaccatctccagagacaattccaagaacacactgtatctgcaaatgaacagcctgagagccgaggacacggccgtatattactgtgcgaaaaaggataatgattacgtttgggggagtccttactttgactactggggccagggaaccctggtcaccgtctcctca

SEQ ID NO: 30142 - protein, 123 aa, Artificial Sequence
  Description of Artificial Sequence: Synthetic polypeptide
EVQLLESGGGLVQPGGSLRLSCAASGFTFNSYAMNWVRQAPGKGLEWVSAISGSGGNTFYADSVKGRFTISRDNSKNTLYLQMNSLRAEDTAVYYCAKKDNDYVWGSPYFDYWGQGTLVTVSS

SEQ ID NO: 30143 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgacctggaacacctccataagcacagcctacatggccctgagcagcctgagatctgaggacacggccgtgtattactgtgcgtatagcagtggctggtactcctttgactactggggccagggaaccctggtcaccgtctcctca

SEQ ID NO: 30144 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTWNTSISTAYMALSSLRSEDTAVYYCAYSSGWYSFDYWGQGTLVTVSS

SEQ ID NO: 30145 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccggttcaccatctccagagacaattccaagaaaacactatatctgcaaatgaacagcctgagagccgaggacacggccgtatattactgtgcgaaacgggtgacggactacggtggtaacgactggttcgacccctggggccagggaaccctggtcaccgtctcctca

SEQ ID NO: 30146 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGNTFYADSVKGRFTISRDNSKKTLYLQMNSLRAEDTAVYYCAKRVTDYGGNDWFDPWGQGTLVTVSS

SEQ ID NO: 30147 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcgagtagcagtggctggtacttttttgactactggggccagggaaccctggtcaccgtctcctca

SEQ ID NO: 30148 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCASSSGWYFFDYWGQGTLVTVSS

SEQ ID NO: 30149 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagcttcagtagctatggcatgcactgggtccgccaggctccaggcaaggggctggagtgggtggcagtgatatggtttgatgaaagtaataaacactatggagactccgtgaagggccgattcaccatctccagggacaattccaagaacacgctgtatctgcaaatgaacagcctgagagccgaggacacggctgtgtattactgtgcgagagaattgggatttctctctgactattggggccagggaaccctggtcaccgtctcctca

SEQ ID NO: 30150 - protein, 117 aa, Artificial Sequence
  Description of Artificial Sequence: Synthetic polypeptide
QVQLVESGGGVVQPGRSLRLSCAASGFSFSSYGMHWVRQAPGKGLEWVAVIWFDESNKHYGDSVKGRFTISRDNSKNTLYLQMNSLRAEDTAVYYCARELGFLSDYWGQGTLVTVSS

SEQ ID NO: 30151 - DNA, 354 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtggtagctacacatactacgcagactcagtgaagggccgattcaccatctccagagacaacgccaagaactcactgtatctgcaaatgaacagcctgagagccgaggacacggctgtgtattactgtgcgagaggtagcagctcgtccgggtttgactactggggccagggaaccctggtcaccgtctcctca

SEQ ID NO: 30152 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISGSGSYTYYADSVKGRFTISRDNAKNSLYLQMNSLRAEDTAVYYCARGSSSSGFDYWGQGTLVTVSS

SEQ ID NO: 30153 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggaggtatagcagcagctggtcggggggtatggacgtctggggccaagggaccacggtcaccgtctcctca

SEQ ID NO: 30154 - protein, 121 aa, Artificial Sequence; identical to SEQ ID NO: 28488
  Description of Artificial Sequence: Synthetic polypeptide

SEQ ID NO: 30155 - DNA, 366 bp, Artificial Sequence
  Description of Artificial Sequence: Synthetic polynucleotide
caggtgctactgcaggagtcgggcccaggactggtgaagccttcacagaccctgtccctcacctgcgctgtctctggtggccccatcagcagtggtgattactactggaactggatccgccagcgcccagggaagggcctggagtggattgggttcatctattacactgggagcacctactacaacccgtccctcaagagtcgagtttccatatcggaagacacgtctgagaaccagttctccctgaacctgagttctgtgactgccgcggacacggccgtgtattactgtgcgagagggggagcttactactcctactacggtatggacgtctggggccaagggaccacggtcaccgtctcctca

SEQ ID NO: 30156 - protein, 122 aa, Artificial Sequence
  Description of Artificial Sequence: Synthetic polypeptide
QVLLQESGPGLVKPSQTLSLTCAVSGGPISSGDYYWNWIRQRPGKGLEWIGFIYYTGSTYYNPSLKSRVSISEDTSENQFSLNLSSVTAADTAVYYCARGGAYYSYYGMDVWGQGTTVTVSS

SEQ ID NO: 30157 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcaccaatagtggttactactatagctggatccgccagcacccagggaagggcctggaatggattgggtacatctattacagtgggggcacctactacaacccgtccctcaagagtcgaattaccatatcagtggacacgtctaacaaccagttctccctgaagctgagctctgtgactgccgcggacacggccgtgtattactgtgcgagagggggatataactggaaccatgcttttgatttctggggccaagggacaatggtcaccgtctcttca

SEQ ID NO: 30158 - protein, 121 aa, Artificial Sequence
  Description of Artificial Sequence: Synthetic polypeptide
QVQLQESGPGLVKPSQTLSLTCTVSGGSITNSGYYYSWIRQHPGKGLEWIGYIYYSGGTYYNPSLKSRITISVDTSNNQFSLKLSSVTAADTAVYYCARGGYNWNHAFDFWGQGTMVTVSS

SEQ ID NO: 30159 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagtagcagtggctggtacttttttgactactggggccagggaaccctggtcaccgtctcctca

SEQ ID NO: 30160 - protein, 118 aa, Artificial Sequence; identical to SEQ ID NO: 29120
  Description of Artificial Sequence: Synthetic polypeptide

SEQ ID NO: 30161 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatgggtgcaccctaacagtggtaacacaggctatgcacagaagttccagggcagagtcaccatgaccaggaacacctccataagcacagcctacatggagctgagcagcctgagatctggggacacggccgtgtattactgtgcggggagcagtggctggtactactttgactactggggccagggcaccctggtcaccgtctcctca

SEQ ID NO: 30162 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWVHPNSGNTGYAQKFQGRVTMTRNTSISTAYMELSSLRSGDTAVYYCAGSSGWYYFDYWGQGTLVTVSS

SEQ ID NO: 30163 - DNA, 369 bp, Artificial Sequence
  Description of Artificial Sequence: Synthetic polynucleotide
caggtgcagctggtggagtctgggggaggcgtggcccagcctgggaggtccctgagactctcctgtgcagcgtctggattcaccttcagtgactatggcatgcactgggtccgccaggctccaggcaaggggctggagtgggtggcagttatatggtatgatggaagtaataagtactatgcagactccgtgaagggccgactcaccatctccagagacaattccaagaacacgttgtatctgcaaatgaacagcctgagcgccgaggacacggctgtgtattactgtgcgagagagaggtatagcagtggctggtacgactacggtttggacgtctggggccaagggaccacggtcaccgtctcctca

SEQ ID NO: 30164 - protein, 123 aa, Artificial Sequence
  Description of Artificial Sequence: Synthetic polypeptide
QVQLVESGGGVAQPGRSLRLSCAASGFTFSDYGMHWVRQAPGKGLEWVAVIWYDGSNKYYADSVKGRLTISRDNSKNTLYLQMNSLSAEDTAVYYCARERYSSGWYDYGLDVWGQGTTVTVSS

SEQ ID NO: 30165 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggttggatgcaccccaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtactggttcgacccctggggccagggaaccctggtcaccgtctcctca

SEQ ID NO: 30166 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYWFDPWGQGTLVTVSS

SEQ ID NO: 30167 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaggtatagcagcagctggacggggggtatggacgtctggggccaagggaccacggtcaccgtctcctca

SEQ ID NO: 30168 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRYSSSWTGGMDVWGQGTTVTVSS

SEQ ID NO: 30169 - DNA, 345 bp, Artificial Sequence
  Description of Artificial Sequence: Synthetic polynucleotide
caggtgcagctacagcagtggggcgcaggactgttgaagccttcggagaccctgtccctcacctgcggtgtctatggtgggtccttcagtgcttactactggagctggatccgccagcccccagggaaggggctggagtggattggggaaatcaatcatagtggaagtaccaactacaaaccgtccctcaagagtcgagtcaccatatcagtagacacgtccaagaaccagttctccctgaagctgagctctgtgaccgccgcggacacggctgtgtattactgtgcgagagactacggtgtttttgactactggggccagggaaccctggtcaccgtctcctca

SEQ ID NO: 30170 - protein, 115 aa, Artificial Sequence
  Description of Artificial Sequence: Synthetic polypeptide
QVQLQQWGAGLLKPSETLSLTCGVYGGSFSAYYWSWIRQPPGKGLEWIGEINHSGSTNYKPSLKSRVTISVDTSKNQFSLKLSSVTAADTAVYYCARDYGVFDYWGQGTLVTVSS

SEQ ID NO: 30171 - DNA, 342 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatccattagtggtagaaacactaccatatactatgcagactctgtgaagggccgattcaccatctccagagacaatgccaagaactcactgtatctgcaaatgaacagcctgagagacgaggacacggctgtttattactgttcgagagatcggggcagttgctggggccagggaaccctggtcaccgtctcctca

SEQ ID NO: 30172 - protein, 114 aa, Artificial Sequence
  Description of Artificial Sequence: Synthetic polypeptide
EVQLVESGGGLVQPGGSLRLSCAASGFTFSSYSMNWVRQAPGKGLEWVSSISGRNTTIYYADSVKGRFTISRDNAKNSLYLQMNSLRDEDTAVYYCSRDRGSCWGQGTLVTVSS

SEQ ID NO: 30173 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccgcttcaccatctccagagacaattccaagaacacgctctatctgcaaatgaacagcctgagagccgaggacacggccgtatattactgtgcgaaaaaggattatgattacgtttgggggagtccttactttgactactggggccagggaaccctggtcaccgtctcctca

SEQ ID NO: 30174 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGNTFYADSVKGRFTISRDNSKNTLYLQMNSLRAEDTAVYYCAKKDYDYVWGSPYFDYWGQGTLVTVSS

SEQ ID NO: 30175 - DNA, 369 bp, Artificial Sequence
  Description of Artificial Sequence: Synthetic polynucleotide
gaggtgcagctgttggagtctgggggaggcttggtacagtctggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccgcttcaccatctccagagacaattccaagaacacgctctatctgcaaatgaacagcctgagagccgaggacacggccgtatattactgtgcgaaaaaggattatgattacgtttgggggagtccttactttgactactggggccagggaaccctggtcaccgtctcctca

SEQ ID NO: 30176 - protein, 123 aa, Artificial Sequence
  Description of Artificial Sequence: Synthetic polypeptide
EVQLLESGGGLVQSGGSLRLSCAASGFTFSSYAMSWVRQAPGKGLEWVSAISGRGGNTFYADSVKGRFTISRDNSKNTLYLQMNSLRAEDTAVYYCAKKDYDYVWGSPYFDYWGQGTLVTVSS

SEQ ID NO: 30177 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatctggtatgatggaagttataaatactatgcagactccgtgaagggccgattcaccatctccagagacaattccaagaacacgctgtatctgcaaatgaacagcctgagtgccgaggacacggctgtgtattactgtgcgagagatcatttcgatttttggagtggtcactttgactactggggccagggaaccctggtcaccgtctcctca

SEQ ID NO: 30178 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSYKYYADSVKGRFTISRDNSKNTLYLQMNSLSAEDTAVYYCARDHFDFWSGHFDYWGQGTLVTVSS

SEQ ID NO: 30179 - DNA, 369 bp, Artificial Sequence; identical to SEQ ID NO: 30173
  Description of Artificial Sequence: Synthetic polynucleotide

SEQ ID NO: 30180 - protein, 123 aa, Artificial Sequence; identical to SEQ ID NO: 30174
  Description of Artificial Sequence: Synthetic polypeptide

SEQ ID NO: 30181 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggcctctggacaagggcttgagtggatgggatggatgcaccctaacagtggtaacacaggctatgcacagaacttccagggcagagtcaccatgaccaggaacacctccataagcacagcctacatggagctgagcagcctgagatctgaggacacggccgtgtattactgtgcgagtagcagtggctggtacttttttgactactggggccagggaaccctggtcaccgtctcctca

SEQ ID NO: 30182 - protein, 118 aa, Artificial Sequence
  Description of Artificial Sequence: Synthetic polypeptide
QVQLVQSGAEVKKPGASVKVSCKASGYTFTNYDINWVRQASGQGLEWMGWMHPNSGNTGYAQNFQGRVTMTRNTSISTAYMELSSLRSEDTAVYYCASSSGWYFFDYWGQGTLVTVSS

SEQ ID NO: 30183 - DNA, 366 bp, Artificial Sequence
  Description of Artificial Sequence: Synthetic polynucleotide
gaggtgcagctcttggagtctgggggaggcttggtacagcctggggggtccctgagactctcctgtgcagcctctggattcacctttagcagctatgccatgaactgggtccgccaggctccagggaaggggctggagtgggtctcagctattagtggtagtggtggtaacacattctacgcagactccgtgaagggccggttcaccatctccagagacaattccaagaacacgctgtatctgcaaatgaacagcctgagagccgaggacacggccgtatattactgtgcgaaacgggtgacggactacggtggtaacgactggttcgacccctggggccagggaaccctggtcaccgtctcctca

SEQ ID NO: 30184 - protein, 122 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGNTFYADSVKGRFTISRDNSKNTLYLQMNSLRAEDTAVYYCAKRVTDYGGNDWFDPWGQGTLVTVSS

SEQ ID NO: 30185 - DNA, 363 bp, Artificial Sequence; identical to SEQ ID NO: 30153
  Description of Artificial Sequence: Synthetic polynucleotide

SEQ ID NO: 30186 - protein, 121 aa, Artificial Sequence; identical to SEQ ID NO: 28488
  Description of Artificial Sequence: Synthetic polypeptide

SEQ ID NO: 30187 - DNA, 363 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaaggtcttgagtggatgggttggatccaccctaacaatggtggcacaaactatgcacagacgtttcagggcagggtcaccatgaccagggacacgtccatcagcacagtctacatggagctgagcaggctgagatctgacgacacggccgtgtattactgtgcgagagatcctgtagtagtaccagctgccccctttgactactggggccagggaaccctggtcaccgtctcctca

SEQ ID NO: 30188 - protein, 121 aa, Artificial Sequence
  Description of Artificial Sequence: Synthetic polypeptide
QVQLVQSGAEVKKPGASVKVSCKASGYTFTGYYMHWVRQAPGQGLEWMGWIHPNNGGTNYAQTFQGRVTMTRDTSISTVYMELSRLRSDDTAVYYCARDPVVVPAAPFDYWGQGTLVTVSS

SEQ ID NO: 30189 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgccaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagtagcagtggctggtactactttgactactggggccagggaaccctggtcaccgtctcctca

SEQ ID NO: 30190 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYYFDYWGQGTLVTVSS

SEQ ID NO: 30191 - DNA, 366 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccggttcaccatctccagagacaattccaagaacacactatatttgcaaatgaacagcctgagagccgaggacacggccgtatattactgtgcgaaacgggtgacggactacggtggtaacgactggttcgacccctggggccagggaaccctggtcaccgtctcctca

SEQ ID NO: 30192 - protein, 122 aa, Artificial Sequence; identical to SEQ ID NO: 30134
  Description of Artificial Sequence: Synthetic polypeptide

SEQ ID NO: 30193 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaagacacggctgtgtattactgtgcgagagatcgttacgatttttggagtggtcactttgactactggggccagggaaccctggtcaccgtctcctca

SEQ ID NO: 30194 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARDRYDFWSGHFDYWGQGTLVTVSS

SEQ ID NO: 30195 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatggagactccgtgaagggccgattcaccatctccagagacaattccaagaacacgctgtatctgcaaatgaacagcctgagagccgaggacacggctgtgtattattgtgcgaggaggtatagcagcagctggtcggggggtatggacgtctggggccaagggaccacggtcaccgtctcctca

SEQ ID NO: 30196 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYGDSVKGRFTISRDNSKNTLYLQMNSLRAEDTAVYYCARRYSSSWSGGMDVWGQGTTVTVSS

SEQ ID NO: 30197 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtgtctccatcagcagaagtagttactactggggctggatccgccagcccccagggaaggggctggagtggattgggagtatctattatagtgggagcacctcctacaacccgtccctcaagagtcgagtcaccatatccgtagacacgtccaagaaccagttctccctgaagctgagctctgtgaccgccgcagacacggctgtgttttactgtgcgagacttgatccccagtggagttttgactactggggccagggaatcctggtcaccgtctcctca

SEQ ID NO: 30198 - protein, 119 aa, Artificial Sequence
  Description of Artificial Sequence: Synthetic polypeptide
QLQLQESGPGLVKPSETLSLTCTVSGVSISRSSYYWGWIRQPPGKGLEWIGSIYYSGSTSYNPSLKSRVTISVDTSKNQFSLKLSSVTAADTAVFYCARLDPQWSFDYWGQGILVTVSS

SEQ ID NO: 30199 - DNA, 366 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcaatggtggttactactggaactggatccgccagcacccagggaagggcctggagtggattgggtacatctattacagtgggagcacctactacaacccgtccctcaagagtcaaattaccatatcagtggacacgtctaaggaccagttctccctgaggctgagctctgtgactgccgcggacacggccgtgtattactgtgcgaggtacagtacctacgactactactacggtatggacgtctggggccaagggaccacggtcaccgtctcctca

SEQ ID NO: 30200 - protein, 122 aa, Artificial Sequence
  Description of Artificial Sequence: Synthetic polypeptide
QVQLQESGPGLVKPSQTLSLTCTVSGGSISNGGYYWNWIRQHPGKGLEWIGYIYYSGSTYYNPSLKSQITISVDTSKDQFSLRLSSVTAADTAVYYCARYSTYDYYYGMDVWGQGTTVTVSS

SEQ ID NO: 30201 - DNA, 363 bp, Artificial Sequence; identical to SEQ ID NO: 30177
  Description of Artificial Sequence: Synthetic polynucleotide

SEQ ID NO: 30202 - protein, 121 aa, Artificial Sequence; identical to SEQ ID NO: 30178
  Description of Artificial Sequence: Synthetic polypeptide

SEQ ID NO: 30203 - DNA, 351 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgaaggaagtaataaatactatgcagactccgtgaagggccgattcaccatctccagagacaattccaagaacatgttgtatctgcaaatgaacagcctgagagccgaggacacggctgtgtattactgtgcgagagaaataggattcagtgaggactactggggccagggaaccctggtcaccgtctcctca

SEQ ID NO: 30204 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYEGSNKYYADSVKGRFTISRDNSKNMLYLQMNSLRAEDTAVYYCAREIGFSEDYWGQGTLVTVSS

SEQ ID NO: 30205 - DNA, 354 bp, Artificial Sequence; identical to SEQ ID NO: 30137
  Description of Artificial Sequence: Synthetic polynucleotide

SEQ ID NO: 30206 - protein, 118 aa, Artificial Sequence; identical to SEQ ID NO: 30138
  Description of Artificial Sequence: Synthetic polypeptide

SEQ ID NO: 30207 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcaactatgccatgacctgggtccgccaggctccagggaaggggctggagtgggtctcagctattagtggtcgtggtggtaacacattctacgcagactccgtgaagggccggttcaccatctccagagacaattccaagaacacgctgtatctgcaaatgaacagcctgagagccgaggacacggccgtatattactgtacgaaacgggtgacggactacggtggtaacgactggttcgacccctggggccagggaaccctggtcaccgtctcctca

SEQ ID NO: 30208 - protein, 122 aa, Artificial Sequence
  Description of Artificial Sequence: Synthetic polypeptide
EVQLLESGGGLVQPGGSLRLSCAASGFTFSNYAMTWVRQAPGKGLEWVSAISGRGGNTFYADSVKGRFTISRDNSKNTLYLQMNSLRAEDTAVYYCTKRVTDYGGNDWFDPWGQGTLVTVSS

SEQ ID NO: 30209 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgacatctgaggacacggccgtgtattactgtgcatatagcagtggctggtactggtttgactactggggccagggaaccctggtcaccgtctcctca

SEQ ID NO: 30210 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLTSEDTAVYYCAYSSGWYWFDYWGQGTLVTVSS

SEQ ID NO: 30211 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacagactatgcacagaagttccagggcagagtcaccatgaccaggaacacctccataaccacagtttacatggagctgagcagcctgagatctgaggacacggccgtgtattattgtacgtttagcagtggctggtactactttgactactggggccagggaaccctggtcaccgtctcctca

SEQ ID NO: 30212 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTDYAQKFQGRVTMTRNTSITTVYMELSSLRSEDTAVYYCTFSSGWYYFDYWGQGTLVTVSS

SEQ ID NO: 30213 - DNA, 366 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcaatggtggttactactggaactggatccgccagcacccagggaagggcctggagtggattgggtacatctattacagtgggagcacctactacaacccgtccctcaagagtcgagttaccatatcagtagacacgtctaaggaccagttctccctgaggctgagctctgtgactgccgcggacacggccgtgtattactgtgcgaggtacagtacctacgactactactacggtatggacgtctggggccaagggaccacggtcaccgtctcctca

SEQ ID NO: 30214 - protein, 122 aa, Artificial Sequence
  Description of Artificial Sequence: Synthetic polypeptide
QVQLQESGPGLVKPSQTLSLTCTVSGGSISNGGYYWNWIRQHPGKGLEWIGYIYYSGSTYYNPSLKSRVTISVDTSKDQFSLRLSSVTAADTAVYYCARYSTYDYYYGMDVWGQGTTVTVSS

SEQ ID NO: 30215 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttattagtggtagtggtggtagcacattctacgcagactccgtgaagggccggttcaccatctccagagacaattccaagaacacgctgtttctgcaaatgaacagcctgagagccgaggacacggccgtatattactgtgcgaaacgaactccggaagatgtttttgatatctggggccaagggacaatggtcaccgtctcttca

SEQ ID NO: 30216 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSVISGSGGSTFYADSVKGRFTISRDNSKNTLFLQMNSLRAEDTAVYYCAKRTPEDVFDIWGQGTMVTVSS

SEQ ID NO: 30217 - DNA, 369 bp, Artificial Sequence
  Description of Artificial Sequence: Synthetic polynucleotide
gaggtgcagctgttggagtctgggggaggcttagtacagcctggggggtccctgagactctcctgtgcagcctctggattcacctttagcagctatgccatgagctgggtccgccaggctccagggaaggggctggagtgggtctcagctattagtggtagtggtggtaacacattctacgcagactccgtgaagggccgcttcaccatctccagagacaattccaagaacacgctgtatctgcacatgaacagcctgagagccgaggacacggccgtttattactgtgcgaaaaaggattatgattacgtttgggggagtccttactttgactactggggccagggaaccctggtcaccgtctcatca

SEQ ID NO: 30218 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGNTFYADSVKGRFTISRDNSKNTLYLHMNSLRAEDTAVYYCAKKDYDYVWGSPYFDYWGQGTLVTVSS

SEQ ID NO: 30219 - DNA, 363 bp, Artificial Sequence
  Description of Artificial Sequence: Synthetic polynucleotide
caggtgcagctgcaggagtcgggcccaggactggtgaagccttcacagaccctgtccctcaattgcactgtctctggtggctccatcagcaacagtggttactactggagctggatccgccagcacccagggaagggcctggaatggattgggtacagctattacagtgggagcacctactacaacccgtccctcaagagtcgaattaccatatcagtagacacgtctaacaaccagttctccctgaagctgagctctgtgactgccgcggacacggccgtgtattactgtgcgagagggggatataactggaaccatgcttttgatatctggggccaagggacaatggtcatcgtctcttca

SEQ ID NO: 30220 - protein, 121 aa, Artificial Sequence
  Description of Artificial Sequence: Synthetic polypeptide
QVQLQESGPGLVKPSQTLSLNCTVSGGSISNSGYYWSWIRQHPGKGLEWIGYSYYSGSTYYNPSLKSRITISVDTSNNQFSLKLSSVTAADTAVYYCARGGYNWNHAFDIWGQGTMVIVSS

SEQ ID NO: 30221 - DNA, 369 bp, Artificial Sequence; identical to SEQ ID NO: 30173
  Description of Artificial Sequence: Synthetic polynucleotide

SEQ ID NO: 30222 - protein, 123 aa, Artificial Sequence; identical to SEQ ID NO: 30174
  Description of Artificial Sequence: Synthetic polypeptide

SEQ ID NO: 30223 - DNA, 369 bp, Artificial Sequence
  Description of Artificial Sequence: Synthetic polynucleotide
caggtgcagctggtggagtctgggggaggcgtggcccagcctgggaggtccctgagactctcctgtgcagcgtctggattcaccttcagtgactatggcatgcactgggtccgccaggctccaggcaaggggctggagtgggtggcagttatatggtatgatggaagtaataagtactatgcagactccgtgaagggccgactcaccatctccagagacaattccaagaacacgctgtatctgcaaatgaacagcctgagagccgaggacacggctgtgtattactgtgcgagagagaggtatagcagtggctggtacgactacggtatggacgtctggggccaagggaccacggtcaccgtctcctca

SEQ ID NO: 30224 - protein, 123 aa, Artificial Sequence
  Description of Artificial Sequence: Synthetic polypeptide
QVQLVESGGGVAQPGRSLRLSCAASGFTFSDYGMHWVRQAPGKGLEWVAVIWYDGSNKYYADSVKGRLTISRDNSKNTLYLQMNSLRAEDTAVYYCARERYSSGWYDYGMDVWGQGTTVTVSS

SEQ ID NO: 30225 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccgcttcaccatctccagagacaattccaagaacacgctctatcggcaaatgaacagcctgagagccgaggacacggccgtatattactgtgcgaaaaaggattatgattacgtttgggggagtccttactttgactactggggccagggaaccctggtcaccgtctcctca

SEQ ID NO: 30226 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGNTFYADSVKGRFTISRDNSKNTLYRQMNSLRAEDTAVYYCAKKDYDYVWGSPYFDYWGQGTLVTVSS

SEQ ID NO: 30227 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgaagaaaataataaatactatgcagactccgtgaagggccgattcaccatctccagagacaattccaagaacacgctgtttctgcaaatgaacagcctgagagccgaggacacggctgtgtattactgtgcgagagaaatagggttcagtgaggactactggggccagggaaccctggtcaccgtctcctca

SEQ ID NO: 30228 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYEENNKYYADSVKGRFTISRDNSKNTLFLQMNSLRAEDTAVYYCAREIGFSEDYWGQGTLVTVSS

SEQ ID NO: 30229 - DNA, 354 bp, Artificial Sequence
  Description of Artificial Sequence: Synthetic polynucleotide
caggtgcagctggtgcaatctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcttatagcagtggctggtactactttgactactggggccagggaaccctggtcaccgtctcctca

SEQ ID NO: 30230 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYYFDYWGQGTLVTVSS

SEQ ID NO: 30231 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggagtatagcagcagctggtacgggtacggtatggacgtctggggccaagggaccacggtcaccgtctcctca

SEQ ID NO: 30232 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCAREEYSSSWYGYGMDVWGQGTTVTVSS

SEQ ID NO: 30233 - DNA, 369 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtaacacattctacgcagactccgtgaagggccgcttcaccatctccagagacaattccaagaacacgctgtatctgcaaatgaacagcctgagagccgaggacacggccgtatattactgtgcgaaaaaggattatgattacgtttgggggagtccttactttgactactggggccagggaaccctggtcaccgtctcctca

SEQ ID NO: 30234 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGNTFYADSVKGRFTISRDNSKNTLYLQMNSLRAEDTAVYYCAKKDYDYVWGSPYFDYWGQGTLVTVSS

SEQ ID NO: 30235 - DNA, 354 bp, Artificial Sequence
  Description of Artificial Sequence: Synthetic polynucleotide
caggtgcagctggtgcagtctggggctgaggtaaagaagcctggggcctcagtgacggtctcctgcaaggcttctggattccccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacttggagctgagcagcctgagatctgaggacacggccgtgtattactgtgcgagtagcagtggctggtacttttttgactactggggccagggaaccctggtcaccgtctcctca

SEQ ID NO: 30236 - protein, 118 aa, Artificial Sequence
  Description of Artificial Sequence: Synthetic polypeptide
QVQLVQSGAEVKKPGASVTVSCKASGFPFTNYDINWVRQATGQGLEWMGWMHPNSGNTGYAQKFQGRVTMTRNTSISTAYLELSSLRSEDTAVYYCASSSGWYFFDYWGQGTLVTVSS

SEQ ID NO: 30237 - DNA, 351 bp, Artificial Sequence; identical to SEQ ID NO: 30227
  Description of Artificial Sequence: Synthetic polynucleotide

SEQ ID NO: 30238 - protein, 117 aa, Artificial Sequence; identical to SEQ ID NO: 30228
  Description of Artificial Sequence: Synthetic polypeptide

SEQ ID NO: 30239 - DNA, 351 bp, Artificial Sequence
  Description of Artificial Sequence: Synthetic polynucleotide
gaggtgcagctggtggagtctgggggaggcttggtgcagcctggggggtccctgagactctcctgtgcagcctcgggatttactttcagtacctatagcatgacttgggtccgccaggctccagggaaggggctggactgggtttcatacattagtaggagtagtagtaccatatactacgcagactctgtgaagggccgattctccatctccagagacaatgccaagaactcactgtatctgcaaatgaacagcctgagagacgaggacacggctctgtattactgtgcgagatcggcatttagcccttttgattactggggccagggaaccctggtcaccgtctcctca

SEQ ID NO: 30240 - protein, 117 aa, Artificial Sequence
  Description of Artificial Sequence: Synthetic polypeptide
EVQLVESGGGLVQPGGSLRLSCAASGFTFSTYSMTWVRQAPGKGLDWVSYISRSSSTIYYADSVKGRFSISRDNAKNSLYLQMNSLRDEDTALYYCARSAFSPFDYWGQGTLVTVSS

SEQ ID NO: 30241 - DNA, 363 bp, Artificial Sequence; identical to SEQ ID NO: 30193
  Description of Artificial Sequence: Synthetic polynucleotide

SEQ ID NO: 30242 - protein, 121 aa, Artificial Sequence; identical to SEQ ID NO: 30194
  Description of Artificial Sequence: Synthetic polypeptide

SEQ ID NO: 30243 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagctattagtggtagtggtggtaacacattctacgcagactccgtgaagggccggttcaccatctccagagacaattccaagaacacgctgaatctgcaaatgagcagcctgagagccgaggacacggccgtatattactgcgcgaaacgggtgacggactacggtggtaacgactggttcgacccctggggccagggaaccctggtcaccgtctcctca

SEQ ID NO: 30244 - protein, 122 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGNTFYADSVKGRFTISRDNSKNTLNLQMSSLRAEDTAVYYCAKRVTDYGGNDWFDPWGQGTLVTVSS

SEQ ID NO: 30245 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatattctatgatggaagtaataaacactatgcagactccgtgaagggccgattcaccatctccagagacaattccaagaacacgctgtatctgcaaatgaacagcctgagagccgaggactcggctgtgtattactgtacgaggaggtttagcagcagctggtcggggggtatggacgtctggggccaagggaccacggtcaccgtctcctca

SEQ ID NO: 30246 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIFYDGSNKHYADSVKGRFTISRDNSKNTLYLQMNSLRAEDSAVYYCTRRFSSSWSGGMDVWGQGTTVTVSS

SEQ ID NO: 30247 - DNA, 366 bp, Artificial Sequence; identical to SEQ ID NO: 30133
  Description of Artificial Sequence: Synthetic polynucleotide

SEQ ID NO: 30248 - protein, 122 aa, Artificial Sequence; identical to SEQ ID NO: 30134
  Description of Artificial Sequence: Synthetic polypeptide

SEQ ID NO: 30249 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggatacaccttcaggagctttagcatgaactgggtccgccaggctccagggaaggggctggagtgggtctcatccattagtagtagtagttattacatatactacgcagactcagtgaagggccgattcaccatctccagagacaacgccaagaactcactgtatctgcaaatgaacagcctgagagccgaagacacggctgtgtattactgtgcgagagatacaccactggtttactggggccagggaaccctggtcaccgtctcctca

SEQ ID NO: 30250 - protein, 115 aa, Artificial Sequence
  Description of Artificial Sequence: Synthetic polypeptide
EVQLVESGGGLVKPGGSLRLSCAASGYTFRSFSMNWVRQAPGKGLEWVSSISSSSYYIYYADSVKGRFTISRDNAKNSLYLQMNSLRAEDTAVYYCARDTPLVYWGQGTLVTVSS

SEQ ID NO: 30251 - DNA, 363 bp, Artificial Sequence
  Description of Artificial Sequence: Synthetic polynucleotide
caggtgcagctgatggagtctgggggaggcgtggtccagcctgggaggtccctgagactctcctgtgcagcgtctggattcatcttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgatacgatttttggagtggtcactttgactactggggccagggaaccctggtcaccgtctcctca

SEQ ID NO: 30252 - protein, 121 aa, Artificial Sequence
  Description of Artificial Sequence: Synthetic polypeptide
QVQLMESGGGVVQPGRSLRLSCAASGFIFSSYGMHWVRQAPGKGLEWVAIIWYDGSNKYYADSVKGRFTISRDNSKNTLYLQMNSLRAEDTAVYYCARDRYDFWSGHFDYWGQGTLVTVSS

SEQ ID NO: 30253 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccacgctccagggaaggggctggagtgggtctcagctattagtggtagtggtaaaaacacattctacgcagactccgtgaagggccggttcaccatctccagagacaattccaagaacacgctgtatctgcaaatgaacagcctgagagccgaggacacggccgtatattactgtgcgaaacgggtgacggactacggtggtaacgactggttcgacccctggggccagggaaccctggtcaccgtctcctca

SEQ ID NO: 30254 - protein, 122 aa, Artificial Sequence
  Description of Artificial Sequence: Synthetic polypeptide
EVQLLESGGGLVQPGGSLRLSCAASGFTFSSYAMNWVRHAPGKGLEWVSAISGSGKNTFYADSVKGRFTISRDNSKNTLYLQMNSLRAEDTAVYYCAKRVTDYGGNDWFDPWGQGTLVTVSS

SEQ ID NO: 30255 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagccgaggacacggctgtgtattactgtgcgagaggggtattactatggttcggggagctagaagatgactggttcgacccctggggccagggaaccctggtcaccgtctcctca

SEQ ID NO: 30256 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGVLLWFGELEDDWFDPWGQGTLVTVSS

SEQ ID NO: 30257 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtggttggcaattatatggtatgatggaagtaataaatactatgcagactccgtgaagggccgattcaccatctccagagacaattccaagaacacgctgtatctacaaatgaacagcctgagagccgaggacacggctgtgtattactgtgcgagagatcattacgatttttggagtggtcactttgactactggggccagggaaccctggtcaccgtctcctca

SEQ ID NO: 30258 - protein, 121 aa, Artificial Sequence
  Description of Artificial Sequence: Synthetic polypeptide
QVQLVESGGGVVQPGRSLRLSCAASGFTFSNYGMHWVRQAPGKGLEWLAIIWYDGSNKYYADSVKGRFTISRDNSKNTLYLQMNSLRAEDTAVYYCARDHYDFWSGHFDYWGQGTLVTVSS

SEQ ID NO: 30259 - DNA, 366 bp, Artificial Sequence; identical to SEQ ID NO: 30145
  Description of Artificial Sequence: Synthetic polynucleotide

SEQ ID NO: 30260 - protein, 122 aa, Artificial Sequence; identical to SEQ ID NO: 30146
  Description of Artificial Sequence: Synthetic polypeptide

SEQ ID NO: 30261 - DNA, 354 bp, Artificial Sequence; identical to SEQ ID NO: 30147
  Description of Artificial Sequence: Synthetic polynucleotide

SEQ ID NO: 30262 - protein, 118 aa, Artificial Sequence; identical to SEQ ID NO: 30148
  Description of Artificial Sequence: Synthetic polypeptide

SEQ ID NO: 30263 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttccccaattatgatatcaactgggtgcgacaggccactggacaaggccttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcatatagcagtggctggtactggtttgactactggggccagggaaccctggtcaccgtctcctca

SEQ ID NO: 30264 - protein, 118 aa, Artificial Sequence
  Description of Artificial Sequence: Synthetic polypeptide
QVQLVQSGAEVKKPGASVKVSCKASGYTFPNYDINWVRQATGQGLEWMGWMHPNSGNTGYAQKFQGRVTMTRNTSISTAYMELSSLRSEDTAVYYCAYSSGWYWFDYWGQGTLVTVSS

SEQ ID NO: 30265 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgacgacacggccgtgtattactgtgcgtatagcagtggctggtactggttcgacccctggggccagggaaccctggtcaccgtctcctca

SEQ ID NO: 30266 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSDDTAVYYCAYSSGWYWFDPWGQGTLVTVSS

SEQ ID NO: 30267 - DNA, 366 bp, Artificial Sequence; identical to SEQ ID NO: 30133
  Description of Artificial Sequence: Synthetic polynucleotide

SEQ ID NO: 30268 - protein, 122 aa, Artificial Sequence; identical to SEQ ID NO: 30134
  Description of Artificial Sequence: Synthetic polypeptide

SEQ ID NO: 30269 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagttataaatactatgcagactccgtgaagggccgattcaccatctccagagacaattccaagaatacgctgtatctgcaaatgaacagcctgagagccgaggacacggctgtgtattactgtgcgagagaggggtacgatttttggagtggttaccttggctactggggccagggaaccctggtcaccgtctcctca

SEQ ID NO: 30270 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSYKYYADSVKGRFTISRDNSKNTLYLQMNSLRAEDTAVYYCAREGYDFWSGYLGYWGQGTLVTVSS

SEQ ID NO: 30271 - DNA, 363 bp, Artificial Sequence
  Description of Artificial Sequence: Synthetic polynucleotide
caggtgcagctgcaggagtcgggcccaggactggtgaagccttcacagaccctgtccctcaattgcactgtctctggtggctccatcagcaacagtggttactactggagctggatccgccagcacccaggcaagggcctggaatggattgggtacagttattacagtgggagcacctactacaacccgtccctcaagagtcgaattaccatatcagtagacacgtctaacaaccagttctccctgaacctgagctctgtgactgccgcggacacggccgtgtattactgtgcgagagggggatataactggaaccatgcttttgatatctggggccaagggacaatggtcaccgtctcttca

SEQ ID NO: 30272 - protein, 121 aa, Artificial Sequence
  Description of Artificial Sequence: Synthetic polypeptide
QVQLQESGPGLVKPSQTLSLNCTVSGGSISNSGYYWSWIRQHPGKGLEWIGYSYYSGSTYYNPSLKSRITISVDTSNNQFSLNLSSVTAADTAVYYCARGGYNWNHAFDIWGQGTMVTVSS

SEQ ID NO: 30273 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatatcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggagtatagcagcagctggtacgggtacggtatggacgtctggggccaagggaccacggtcaccgtctcctca

SEQ ID NO: 30274 - protein, 123 aa, Artificial Sequence
  Description of Artificial Sequence: Synthetic polypeptide
QVQLVESGGGVVQPGRSLRLSCAASGFTFSSYIMHWVRQAPGKGLEWVAVIWYDGSNKYYADSVKGRFTISRDNSKNTLYLQMNSLRAEDTAVYYCAREEYSSSWYGYGMDVWGQGTTVTVSS

SEQ ID NO: 30275 - DNA, 369 bp, Artificial Sequence; identical to SEQ ID NO: 30141
  Description of Artificial Sequence: Synthetic polynucleotide

SEQ ID NO: 30276 - protein, 123 aa, Artificial Sequence; identical to SEQ ID NO: 30142
  Description of Artificial Sequence: Synthetic polypeptide

SEQ ID NO: 30277 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagcagaagtagttactactggggctggatccgccagcccccagggaaggggctggagtggattgggagtatctattatagtgggagcgcctcctacaacccgtccctcaagagtcgagtcaccatatccgtagacacgtccaagaaccagttctccctgaagctgagctctgtgaccgccgcagacacggctgtgttttactgtgcgagacttgatctccagtggagttttgacttctggggccagggaaccctggtcaccgtctcctca

SEQ ID NO: 30278 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGSIYYSGSASYNPSLKSRVTISVDTSKNQFSLKLSSVTAADTAVFYCARLDLQWSFDFWGQGTLVTVSS

SEQ ID NO: 30279 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtaattactactggagctggatccggcagcccgccgggaagggactggagtggattgggcgtatcgataccagtgggatcaccaactacaacccctccctcaagagtcgagtcaccatgtcagtcgacacgtccaagaaccagttctccctgaagctgacctctgtgaccgccgcggacacggccgtgtattactgtgcgagagaggggggattgggagctaccttctttgactactggggccagggaaccctggtcaccgtctcctca

SEQ ID NO: 30280 - protein, 119 aa, Artificial Sequence
  Description of Artificial Sequence: Synthetic polypeptide
QVQLQESGPGLVKPSETLSLTCTVSGGSISNYYWSWIRQPAGKGLEWIGRIDTSGITNYNPSLKSRVTMSVDTSKNQFSLKLTSVTAADTAVYYCAREGGLGATFFDYWGQGTLVTVSS

SEQ ID NO: 30281 - DNA, 369 bp, Artificial Sequence; identical to SEQ ID NO: 30173
  Description of Artificial Sequence: Synthetic polynucleotide

SEQ ID NO: 30282 - protein, 123 aa, Artificial Sequence; identical to SEQ ID NO: 30174
  Description of Artificial Sequence: Synthetic polypeptide

SEQ ID NO: 30283 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagctattagtggtcgtggtggtaacacattctacgcagactccgtgaagggccggttcaccatctccagagacaattccaagaacacactatatctgcaaatgaacagcctgagagccgaggacacggccgtatattactgtgcgaaacgggtgacggactacggtggtaacgactggttcgacccctggggccagggaaccctggtcaccgtctcctca

SEQ ID NO: 30284 - protein, 122 aa, Artificial Sequence
  Description of Artificial Sequence: Synthetic polypeptide
EVQLLESGGGLVQPGGSLRLSCAASGFTFSSYAMNWVRQAPGKGLEWVSAISGRGGNTFYADSVKGRFTISRDNSKNTLYLQMNSLRAEDTAVYYCAKRVTDYGGNDWFDPWGQGTLVTVSS

SEQ ID NO: 30285 - DNA, 363 bp, Artificial Sequence
  Description of Artificial Sequence: Synthetic polynucleotide
caggtacaactggtggagtctgggggaggcgtggtccagcctgggaggtccctgagactctcctgtgcagcgtctggattcaccttccgtaactatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggcttacgatttttggagtggttattttgactactggggccagggaattctggtcaccgtctcctca

SEQ ID NO: 30286 - protein, 121 aa, Artificial Sequence
  Description of Artificial Sequence: Synthetic polypeptide
QVQLVESGGGVVQPGRSLRLSCAASGFTFRNYGMHWVRQAPGKGLEWVAIIWYDGSNKYYADSVKGRFTISRDNSKNTLYLQMNSLRAEDTAVYYCAREAYDFWSGYFDYWGQGILVTVSS

SEQ ID NO: 30287 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcttatagcagtggctggtactactttgactactggggccagggaaccctggtcaccgtctcctca

SEQ ID NO: 30288 - protein, 118 aa, Artificial Sequence; identical to SEQ ID NO: 30000
  Description of Artificial Sequence: Synthetic polypeptide

SEQ ID NO: 30289 - DNA, 345 bp, Artificial Sequence
  Description of Artificial Sequence: Synthetic polynucleotide
gaggtgcagctgttggagtctgggggaggcctggtacagcctggggggtccctgagactctcctgtgcagcctctggattcagctttagcagctatgtcatgagttgggtccgccagggtccagggaaggggctggagtgggtctcagctattagtggaagtggtgatagaacatactacgcagactccgtgaagggccggttcaccatctccagagacaattccaagaacacgctgtacctgcaaatgaacagcctgagagccgaggacacggccgtatattactgtgcgcgtacggcgactaaggactactggggccagggaaccctggtcaccgtctcctca

SEQ ID NO: 30290 - protein, 115 aa, Artificial Sequence
  Description of Artificial Sequence: Synthetic polypeptide
EVQLLESGGGLVQPGGSLRLSCAASGFSFSSYVMSWVRQGPGKGLEWVSAISGSGDRTYYADSVKGRFTISRDNSKNTLYLQMNSLRAEDTAVYYCARTATKDYWGQGTLVTVSS

SEQ ID NO: 30291 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagttataaatactatgcagactccgtgaagggccgattcaccatctccagagacaattccaagaacacggtgtatctgcaaatgaacagcctgagagccgaggacacggctgtatattactgtgcgagagaggggtacgatttttggagtggttaccttggctactggggccagggaaccctggtcaccgtctcctca

SEQ ID NO: 30292 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSYKYYADSVKGRFTISRDNSKNTVYLQMNSLRAEDTAVYYCAREGYDFWSGYLGYWGQGTLVTVSS

SEQ ID NO: 30293 - DNA, 363 bp, Artificial Sequence
  Description of Artificial Sequence: Synthetic polynucleotide
caggtgcagctgcaggagtcgggcccaggactggtgaagccttcacagaccctgtccctcaattgcactgtctctggtggctccatcagcaacagtggttactactggagctggatccgccagcacccaggcaagggcctggaatggattgggtacagctattacagtgggagcacctactacaacccgtccctcaagagtcgaattaccatatcagtagacacgtctaacaaccagttctccctgaacctgagctctgtgactgccgcggacacggccgtgtattactgtgcgagagggggatataactggaaccatgcttttgatatctggggccaagggacaatggtcaccgtctcttca

SEQ ID NO: 30294 - protein, 121 aa, Artificial Sequence; identical to SEQ ID NO: 30272
  Description of Artificial Sequence: Synthetic polypeptide

SEQ ID NO: 30295 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatcgataccagtgggatcaccaactacaacccctccctcaagagtcgagtcaccatgtcagtcgacacgtccaagaaccagttctccctgaagctgacctctgtgaccgccgcggacacggccgtgtattactgtgcgagagaggggggagtgggagctacgtactttgactactggggccagggaaccctggtcaccgtctcctca

SEQ ID NO: 30296 - protein, 119 aa, Artificial Sequence
  Description of Artificial Sequence: Synthetic polypeptide
QVQLQESGPGLVKPSETLSLTCTVSGGSISSYYWSWIRQPAGKGLEWIGRIDTSGITNYNPSLKSRVTMSVDTSKNQFSLKLTSVTAADTAVYYCAREGGVGATYFDYWGQGTLVTVSS

SEQ ID NO: 30297 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcacttatattctatgatggaagtaataaatactatgcagactccgtgaagggccgattcaccatctccagagacaattccaagaacacgctgtatctgcaaataaacagcctgagagccgaggacacggctgtgtatttctgtgcgcgacgctatagccgcagctgggccgggggtatggacgtctggggccaagggaccgcggtcaccgtctcctca

SEQ ID NO: 30298 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVALIFYDGSNKYYADSVKGRFTISRDNSKNTLYLQINSLRAEDTAVYFCARRYSRSWAGGMDVWGQGTAVTVSS

SEQ ID NO: 30299 - DNA, 354 bp, Artificial Sequence
  Description of Artificial Sequence: Synthetic polynucleotide
caggtgcagctggtgcagtctggggctgaggtgaaggagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaatacctccataaacacagcctacatggagctgagcagcctgagatctgaggacacggccgtgtattactgtgcgtatagcagtggctggtacttctttgacaactggggccagggaaccctggtcaccgtctcctca

SEQ ID NO: 30300 - protein, 118 aa, Artificial Sequence
  Description of Artificial Sequence: Synthetic polypeptide
QVQLVQSGAEVKEPGASVKVSCKASGYTFTNYDINWVRQATGQGLEWMGWMHPNSGNTGYAQKFQGRVTMTRNTSINTAYMELSSLRSEDTAVYYCAYSSGWYFFDNWGQGTLVTVSS

SEQ ID NO: 30301 - DNA, 354 bp, Artificial Sequence; identical to SEQ ID NO: 29943
  Description of Artificial Sequence: Synthetic polynucleotide

SEQ ID NO: 30302 - protein, 118 aa, Artificial Sequence; identical to SEQ ID NO: 29944
  Description of Artificial Sequence: Synthetic polypeptide

SEQ ID NO: 30303 - DNA, 369 bp, Artificial Sequence
  Description of Artificial Sequence: Synthetic polynucleotide
gaggtgaagttgttggagtctgggggaggcttggtacagccgggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccggttcaccatctccagagacaattccaagaacacgctgtttctgcaaatgaacagcctgagagccgaggacacggccgtatattactgtgcgaaaaggggatttcgatttttggagtggttggggggctttgactactggggccagggaaccctggtcaccgtctcctca

SEQ ID NO: 30304 - protein, 123 aa, Artificial Sequence
  Description of Artificial Sequence: Synthetic polypeptide
EVKLLESGGGLVQPGGSLRLSCAASGFTFSSYAMSWVRQAPGKGLEWVSAISGRGGNTFYADSVKGRFTISRDNSKNTLFLQMNSLRAEDTAVYYCAKRGFRFLEWLGGFDYWGQGTLVTVSS

SEQ ID NO: 30305 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaggggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagtagcagtggctggtactacttcgactactggggccagggaaccctggtcaccgtctcctca

SEQ ID NO: 30306 - protein, 118 aa, Artificial Sequence; identical to SEQ ID NO: 30190
  Description of Artificial Sequence: Synthetic polypeptide

SEQ ID NO: 30307 - DNA, 369 bp, Artificial Sequence
  Description of Artificial Sequence: Synthetic polynucleotide
gaggtgcagctgttggagtctgggggaggcttggtacagcctggggggtccctgagactctcttgtgcagcctctggattcacctttaacagctatgccatgagctgggtccgccaggctccagggaaggggctggagtgggtctcagctattagtggtagtggtggtaacacattctacgcagactccgtgaagggccgcttcaccatctccagagacaattccaagaacacgctgtatctgcaaatgaacagcctgagagccgaggacacggccgtatattactgtgcgaaaaaggattatgattacgtttgggggagtccttactttgactactggggccagggaaccctggtcaccgtctcctca

SEQ ID NO: 30308 - protein, 123 aa, Artificial Sequence
  Description of Artificial Sequence: Synthetic polypeptide
EVQLLESGGGLVQPGGSLRLSCAASGFTFNSYAMSWVRQAPGKGLEWVSAISGSGGNTFYADSVKGRFTISRDNSKNTLYLQMNSLRAEDTAVYYCAKKDYDYVWGSPYFDYWGQGTLVTVSS

SEQ ID NO: 30309 - DNA, 369 bp, Artificial Sequence; identical to SEQ ID NO: 30233
  Description of Artificial Sequence: Synthetic polynucleotide

SEQ ID NO: 30310 - protein, 123 aa, Artificial Sequence; identical to SEQ ID NO: 30234
  Description of Artificial Sequence: Synthetic polypeptide

SEQ ID NO: 30311 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtggtaacacattctacgcagactccgtgaagggccggttcaccatctccagagacaattccaagaacacgctgtatctgcaaatgaacagtctgagagccgaggacacggccgtatattactgtgcgaaacgggtgacggactacggtggtaacgactggttcgacccctggggccagggaaccctggtcaccgtctcctca

SEQ ID NO: 30312 - protein, 122 aa, Artificial Sequence; identical to SEQ ID NO: 30134
  Description of Artificial Sequence: Synthetic polypeptide

SEQ ID NO: 30313 - DNA, 363 bp, Artificial Sequence
  Description of Artificial Sequence: Synthetic polynucleotide
caggtgcagctagtggagtctgggggagacgtggtccagcctgggaggtccctgaggctctcctgtgcagcgtctggattcaccttcagtagctatggcatgcactgggtccgccaggctccaggcaaggggctggagtgggtggcaattatatggtatgatggaagtagtaaatactatgcagactccgtgaagggccgattcaccatctccagagacaattccaagaacacgctgtatctgcacatgaacagcctgagagccgaggacacggcagtgtattactgtgcgagagatcgatacgatttttggagtggtcactttgactactggggccagggaaccctggtcaccgtctcctca

SEQ ID NO: 30314 - protein, 121 aa, Artificial Sequence
  Description of Artificial Sequence: Synthetic polypeptide
QVQLVESGGDVVQPGRSLRLSCAASGFTFSSYGMHWVRQAPGKGLEWVAIIWYDGSSKYYADSVKGRFTISRDNSKNTLYLHMNSLRAEDTAVYYCARDRYDFWSGHFDYWGQGTLVTVSS

SEQ ID NO: 30315 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtagtacaggctatgcacagaggttccagggcagagtcaccatgaccaggaacacctccataagcacagcctacatggagctgagcagcctgagatctgaggacacggccgtgtattactgtgcgtttagcagtggctggtactattttgactactggggccagggaaccctggtcaccgtctcctca

SEQ ID NO: 30316 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGSTGYAQRFQGRVTMTRNTSISTAYMELSSLRSEDTAVYYCAFSSGWYYFDYWGQGTLVTVSS

SEQ ID NO: 30317 - DNA, 354 bp, Artificial Sequence; identical to SEQ ID NO: 30287
  Description of Artificial Sequence: Synthetic polynucleotide

SEQ ID NO: 30318 - protein, 118 aa, Artificial Sequence; identical to SEQ ID NO: 30000
  Description of Artificial Sequence: Synthetic polypeptide

SEQ ID NO: 30319 - DNA, 366 bp, Artificial Sequence
  Description of Artificial Sequence: Synthetic polynucleotide
gaggtgcaactattggagtctgggggaggcttggttcagcctggggggtccctgagactctcctgtgcagcctctggattcacctttagcagctatgccatgaactgggtccgccaggctccagggaaggggctggaatgggtctcaactattagtggtagaggtcttggcacatactacgcagactccgtgaagggccggttcaccatctccagagacaattccaagaacacgctgtatctgcaactgaacagcctgagagccgaggacacggccgtatattactgtgcgaaagaccatgactacggtgactacaatatctactttgactactggggccagggaaccctggtcaccgtctcctca

SEQ ID NO: 30320 - protein, 122 aa, Artificial Sequence
  Description of Artificial Sequence: Synthetic polypeptide
EVQLLESGGGLVQPGGSLRLSCAASGFTFSSYAMNWVRQAPGKGLEWVSTISGRGLGTYYADSVKGRFTISRDNSKNTLYLQLNSLRAEDTAVYYCAKDHDYGDYNIYFDYWGQGTLVTVSS

SEQ ID NO: 30321 - DNA, 357 bp, Artificial Sequence; identical to SEQ ID NO: 30277
  Description of Artificial Sequence: Synthetic polynucleotide

SEQ ID NO: 30322 - protein, 119 aa, Artificial Sequence; identical to SEQ ID NO: 30278
  Description of Artificial Sequence: Synthetic polypeptide

SEQ ID NO: 30323 - DNA, 354 bp, Artificial Sequence; identical to SEQ ID NO: 30137
  Description of Artificial Sequence: Synthetic polynucleotide

SEQ ID NO: 30324 - protein, 118 aa, Artificial Sequence; identical to SEQ ID NO: 30138
  Description of Artificial Sequence: Synthetic polypeptide

SEQ ID NO: 30325 - DNA, 366 bp, Artificial Sequence; identical to SEQ ID NO: 30133
  Description of Artificial Sequence: Synthetic polynucleotide

SEQ ID NO: 30326 - protein, 122 aa, Artificial Sequence; identical to SEQ ID NO: 30134
  Description of Artificial Sequence: Synthetic polypeptide

SEQ ID NO: 30327 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagaatgaactgggtccgccaggctccagggaaggggctggagtgggtctcatccatgagtaatagtagtagttccatatactacgcagactcagtgaagggccgattcaccatctccagagacaacgccaagaactcactgtatctgcaaatgaacagcctgagagccgaggacacggctgtgtattactgtgcgagacaggcagcccaggactactggggccagggaaccctggtcaccgtctcctca

SEQ ID NO: 30328 - protein, 115 aa, Artificial Sequence
  Description of Artificial Sequence: Synthetic polypeptide
EVQLVESGGGLVKPGGSLRLSCAASGFTFSSYRMNWVRQAPGKGLEWVSSMSNSSSSIYYADSVKGRFTISRDNAKNSLYLQMNSLRAEDTAVYYCARQAAQDYWGQGTLVTVSS

SEQ ID NO: 30329 - DNA, 336 bp, Artificial Sequence
  Description of Artificial Sequence: Synthetic polynucleotide
gaggtgcagctgttggagtctgggggagggttggtacagcctggggggtccctgagactctcctgtgcagcctctggattcacctttagcagttatgccatgaggtggatccgccaggctccagggaaggggctgcagtgggtctcagatattagtggtagtggtggtaccacatactacgcagactccgtgaagggccggttcaccatctccagagacaattccaagaacacgctgtatctgcaaatgaacagcctgagagccgaggacacggccgtatattactgtgcgaagacctacctctggggccagggaaccctggtcaccgtctcctca

SEQ ID NO: 30330 - protein, 112 aa, Artificial Sequence
  Description of Artificial Sequence: Synthetic polypeptide
EVQLLESGGGLVQPGGSLRLSCAASGFTFSSYAMRWIRQAPGKGLQWVSDISGSGGTTYYADSVKGRFTISRDNSKNTLYLQMNSLRAEDTAVYYCAKTYLWGQGTLVTVSS

SEQ ID NO: 30331 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggctgttatatggtatgatgtaaataataaatactatgcagactccgtgaagggccgattcaccatctccagagacaattccaagaacacgctgtatctgcaaatgaacagcctgagagccgaggacacggctgtgtattactgtgcgagagagctggggttcctctctgactattggggccagggaaccctggtcaccgtctcctca

SEQ ID NO: 30332 - protein, 117 aa, Artificial Sequence
  Description of Artificial Sequence: Synthetic polypeptide
QVQLVESGGGVVQPGRSLRLSCAASGFTFSTYGMHWVRQAPGKGLEWVAVIWYDVNNKYYADSVKGRFTISRDNSKNTLYLQMNSLRAEDTAVYYCARELGFLSDYWGQGTLVTVSS

SEQ ID NO: 30333 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctgaattcacctttagcacctatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgaaaaggagcagtggctggtacgaggatgctcttgatatctggggccaagggacaatggtcaccgtctcttca

SEQ ID NO: 30334 - protein, 121 aa, Artificial Sequence
  Description of Artificial Sequence: Synthetic polypeptide
EVQLLESGGGLVQPGGSLRLSCAASEFTFSTYAMSWVRQAPGKGLEWVSVISGSGGSTYYADSVKGRFTISRDNSKNTLYLQMNSLRAEDTAVYYCAKRSSGWYEDALDIWGQGTMVTVSS

SEQ ID NO: 30335 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataccatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgaaagccgaggacacggctgtgtattactgtgcgagagtagctacctttgactactggggccagggaaccctggtcaccgtctcctca

SEQ ID NO: 30336 - protein, 115 aa, Artificial Sequence
  Description of Artificial Sequence: Synthetic polypeptide
EVQLVESGGGLVKPGGSLRLSCAASGFTFSSYTMNWVRQAPGKGLEWVSSISGSSSYIYYADSVKGRFTISRDNAKNSLYLQMNSLKAEDTAVYYCARVATFDYWGQGTLVTVSS

SEQ ID NO: 30337 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgaactgggtccgccaggctccagggaaggggctggagtgggtctcatccattagtagtagtagtacttacatatactacgcagactcagtgaagggccgattcaccatctccagagacaacgccaagaactcactgtatctgcaaatgaacagcctgagagccgaggacacggctgtgtattactgtgcgagagatagagggtccatctggggccagggaaccctggtcaccgtctcctca

SEQ ID NO: 30338 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISSSSTYIYYADSVKGRFTISRDNAKNSLYLQMNSLRAEDTAVYYCARDRGSIWGQGTLVTVSS

SEQ ID NO: 30339 - DNA, 345 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagtagctatgtcatgagctgggtccgccaggctccagggaagggactggactgggtctcagctatgagtggtagtggtggtagaacatactacgcagactccgtgaagggccggttcaccatctccagagacaattccaagaacacgctgtatctgcaaatgaacagcctgagagccgaggacacggccgtgtattactgtgcgaagtatacctggaacggctactggggccagggaaccctggtcaccgtctcctca

SEQ ID NO: 30340 - protein, 115 aa, Artificial Sequence
  Description of Artificial Sequence: Synthetic polypeptide
EVQLLESGGGLVQPGGSLRLSCAASGFTFSSYVMSWVRQAPGKGLDWVSAMSGSGGRTYYADSVKGRFTISRDNSKNTLYLQMNSLRAEDTAVYYCAKYTWNGYWGQGTLVTVSS

SEQ ID NO: 30341 - DNA, 357 bp, Artificial Sequence
  Description of Artificial Sequence: Synthetic polynucleotide
cagctgcacctgcaggagtcgggcccaggactggtgaagccttcggagaccctgtccctcacctgcactgtctctggtggctccatcagcagtggtagttactactggggctggatccgccagcccccagggaagggactggagtggattgggagtatctactatagtgggagcacctactacaatccgtccctcaagagtcgagtcaccatatccgtagacacgtccaagaaccagttctccctgaacctgagctctgtgaccgccgcagacacggctgtctattactgtgcgagacataaagtggctggtccctttgactactggggccagggaaccctggtcaccgtctcctca

SEQ ID NO: 30342 - protein, 119 aa, Artificial Sequence
  Description of Artificial Sequence: Synthetic polypeptide
QLHLQESGPGLVKPSETLSLTCTVSGGSISSGSYYWGWIRQPPGKGLEWIGSIYYSGSTYYNPSLKSRVTISVDTSKNQFSLNLSSVTAADTAVYYCARHKVAGPFDYWGQGTLVTVSS

SEQ ID NO: 30343 - DNA, 342 bp, Artificial Sequence
  Description of Artificial Sequence: Synthetic polynucleotide
gaggtgcaactggtggagtctgggggaggcctggtcaagcctggggggtccctgagattctcctgtgcagcctctggattcaccttcagtagttatagcatgaactgggtccgccaggctccagggaaggggctggagtgggtctcatccattagtggtagtagtacgtacatatactacgcagactcagtgaagggccgattcaccatctccagagacaacgccaagaactcactgtatctgcaaatgaacagcctgagagccgaagacacggctgtgtattactgtgcgagagatcggggcagcagctggggccagggaaccctggtcaccgtctcctca

SEQ ID NO: 30344 - protein, 114 aa, Artificial Sequence
  Description of Artificial Sequence: Synthetic polypeptide
EVQLVESGGGLVKPGGSLRFSCAASGFTFSSYSMNWVRQAPGKGLEWVSSISGSSTYIYYADSVKGRFTISRDNAKNSLYLQMNSLRAEDTAVYYCARDRGSSWGQGTLVTVSS

SEQ ID NO: 30345 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcacattcagtagctatagcatgaactgggtccgccaggctccagggaaggggctagagtgggtctcatgcattagtggtagtagtagttacatatattatgcagactcagtgaagggccgattcaccatgtccagagacaacgccaagaactcactgtatctgcaaatgaacagcctgagagccgaggacacggctgtgtattactgtgtgagagatcgagggggctattggggccagggaaccctggtcaccgtctcctca

SEQ ID NO: 30346 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSCISGSSSYIYYADSVKGRFTMSRDNAKNSLYLQMNSLRAEDTAVYYCVRDRGGYWGQGTLVTVSS

SEQ ID NO: 30347 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaattatggcatgcactgggtccgccaggctccaggcaaggggctggagtgggtggcaattatatggtatgatggaagttataaatactatgcagactccgtgaagggccgattcaccgtctccagagacaattccaagaacacgctgtatctgcaaatgaacagcctgagagccgaggacacggctgtgtattactgtgcgagagagggatacgatttttggagtggtttctttgactcctggggccagggaaccctggtcaccgtctcctca

SEQ ID NO: 30348 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAIIWYDGSYKYYADSVKGRFTVSRDNSKNTLYLQMNSLRAEDTAVYYCAREGYDFWSGFFDSWGQGTLVTVSS

SEQ ID NO: 30349 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggctgttatatggtatgatgtaaataataaatactatgcagactccgtgaagggccgattcaccatctccagagacaattccaagaacacgctgtatctgcaaatgaacagcctgagagccgaggacacggctgtgtattactgtgcgagagagctggggttcctctctgactactggggccagggaaccctggtcaccgtctcctca

SEQ ID NO: 30350 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDVNNKYYADSVKGRFTISRDNSKNTLYLQMNSLRAEDTAVYYCARELGFLSDYWGQGTLVTVSS

SEQ ID NO: 30351 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctataccatgaactgggtccgccaggctccagggaaggggctggagtgggtctcatccattagtggtagcagtagttacataaactacgcagactcagtgaagggccgattcaccatctccagagacaacgccaagaactcactgtatctgcaaatgaacagcctgagagccgaggacacggctgtgtattactgtgcgagagtggctcactttgactactggggccagggaaccctggtcaccgtctcctca

SEQ ID NO: 30352 - protein, 115 aa, Artificial Sequence
  Description of Artificial Sequence: Synthetic polypeptide
EVQLVESGGGLVKPGGSLRLSCAASGFTFSSYTMNWVRQAPGKGLEWVSSISGSSSYINYADSVKGRFTISRDNAKNSLYLQMNSLRAEDTAVYYCARVAHFDYWGQGTLVTVSS

SEQ ID NO: 30353 - DNA, 342 bp, Artificial Sequence
  Description of Artificial Sequence: Synthetic polynucleotide
gaggtgcagtgggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtggtagttacataaactacgcagactcagtgaagggccggttcaccatctccagagacaacgccaagacctcactgtatctgcaagtgaacggcctgagagccgaggacacggctgtgtattactgtgcgagatccaagtttgactcctggggccagggaaccctggtcaccgtctcctca

SEQ ID NO: 30354 - protein, 114 aa, Artificial Sequence
  Description of Artificial Sequence: Synthetic polypeptide
EVQWVESGGGLVKPGGSLRLSCAASGFTFSSYSMNWVRQAPGKGLEWVSSISGSGSYINYADSVKGRFTISRDNAKTSLYLQVNGLRAEDTAVYYCARSKFDSWGQGTLVTVSS

SEQ ID NO: 30355 - DNA, 342 bp, Artificial Sequence
  Description of Artificial Sequence: Synthetic polynucleotide
gaggtgcagctggtggaatctgggggaggcctggtcaagcctggggggtccctgagactctcctgtgcagcctctggattcaccttcagtagttatggcatgaactgggtccgccaggctccagggaaggggctggagtggatctcatccattagtggtagtggtagttacatatactacgcagactcagtgaagggccgattcaccatttccagagacaacgccaagaactcactgtatctgcaaatgaacagcctgagagccgaggacacggctgtgtattactgtgcgattagcagtggctggtcttggggccagggaaccctggtcaccgtctcctca

SEQ ID NO: 30356 - protein, 114 aa, Artificial Sequence
  Description of Artificial Sequence: Synthetic polypeptide
EVQLVESGGGLVKPGGSLRLSCAASGFTFSSYGMNWVRQAPGKGLEWISSISGSGSYIYYADSVKGRFTISRDNAKNSLYLQMNSLRAEDTAVYYCAISSGWSWGQGTLVTVSS

SEQ ID NO: 30357 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatgcactgggtccgccaggctccaggcaaggggctggagtgggtgtcagttatatggtatgatggaagtaataaatactatgcagactccgtgaagggccgattcaccatctccagagacaattccaagaacacactgtatctgcaaatgaacagcctgagagccgaggacacggctgtgtattactgtgcgagagaaccgtatactagtggctggtacgactacggtatggacgtctggggccaagggaccacggtcaccgtctcctca

SEQ ID NO: 30358 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVSVIWYDGSNKYYADSVKGRFTISRDNSKNTLYLQMNSLRAEDTAVYYCAREPYTSGWYDYGMDVWGQGTTVTVSS

SEQ ID NO: 30359 - DNA, 348 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagtcacttctggagctggatccggcagcccgccgggaagggactggagtggattggccgtatctataccagtgggaccaccaactacaccccctccctcaagagtcgagtcaccatgtcagtagacacgtccaagaaccagttctccctgaagctgagctctgtgaccgccgcggacacggccgtgtattactgtgcgagattgagcagtggctggtttgactactggggccagggaaccctggtcaccgtctcctca

SEQ ID NO: 30360 - protein, 116 aa, Artificial Sequence
  Description of Artificial Sequence: Synthetic polypeptide
QVQLQESGPGLVKPSETLSLTCTVSGGSISSHFWSWIRQPAGKGLEWIGRIYTSGTTNYTPSLKSRVTMSVDTSKNQFSLKLSSVTAADTAVYYCARLSSGWFDYWGQGTLVTVSS

SEQ ID NO: 30361 - DNA, 342 bp, Artificial Sequence; identical to SEQ ID NO: 30343
  Description of Artificial Sequence: Synthetic polynucleotide

SEQ ID NO: 30362 - protein, 114 aa, Artificial Sequence; identical to SEQ ID NO: 30344
  Description of Artificial Sequence: Synthetic polypeptide

SEQ ID NO: 30363 - DNA, 342 bp, Artificial Sequence
  Description of Artificial Sequence: Synthetic polynucleotide
gaggtgcaactggtggagtctgggggaggcctggtcaagcctggggggtccctgagactctcctgtgcagcctctgggttcaccttcagtagctatagcatgaactgggtccgccaggctccagggaaggggctggagtgggtctcatccatcagtggtagtagtacttacatatactacgcagactcagtgaagggccgattcaccatctccagagacaacgccaagaactcactgcatctgcaaatgaacagcctgagagccgaggacacggctgtgtattactgtgcgagagatcggggcagcagctggggccagggaaccctggtcaccgtctcctca

SEQ ID NO: 30364 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYIYYADSVKGRFTISRDNAKNSLHLQMNSLRAEDTAVYYCARDRGSSWGQGTLVTVSS

SEQ ID NO: 30365 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagtgtctggattcaccttcagtagctatggcatgcactgggtccgccaggctccaggcaaggggctggagtgggtggcagttatatggtatgatgtaactaataaatactatgcagactccgtgaagggccgattcaccatctccagagacaattccaagaacacgctgtatctgcaaatgaacagcctgagagacgaggacacggctgtgtattattgtgtgagagaactgggatgggcggaggactactggggccagggaaccctggtcaccgtctcctca

SEQ ID NO: 30366 - protein, 117 aa, Artificial Sequence
  Description of Artificial Sequence: Synthetic polypeptide
QVQLVESGGGVVQPGRSLRLSCAVSGFTFSSYGMHWVRQAPGKGLEWVAVIWYDVTNKYYADSVKGRFTISRDNSKNTLYLQMNSLRDEDTAVYYCVRELGWAEDYWGQGTLVTVSS

SEQ ID NO: 30367 - DNA, 342 bp, Artificial Sequence
  Description of Artificial Sequence: Synthetic polynucleotide
gaggtgcagctggtggagtctgggggaggcctggtcacgcctggggggtccctgagactctcctgtgcagcctctggattcaccttcagtagctataccatgaactgggtccgccaggctccagggaaggggctggagtgggtctcattgattagtggcagtagtagttacatatactacgcagactcagtgaagggccgattcaccatctccagagacaacgccaagaactcactgtatctgcaaatgaacagcctgagagccgaggacacggctgtgtattactgtgcgagagatcgaggcagcctctggggccagggaaccctggtcaccgtctcctca

SEQ ID NO: 30368 - protein, 114 aa, Artificial Sequence
  Description of Artificial Sequence: Synthetic polypeptide
EVQLVESGGGLVTPGGSLRLSCAASGFTFSSYTMNWVRQAPGKGLEWVSLISGSSSYIYYADSVKGRFTISRDNAKNSLYLQMNSLRAEDTAVYYCARDRGSLWGQGTLVTVSS

SEQ ID NO: 30369 - DNA, 354 bp, Artificial Sequence
  Description of Artificial Sequence: Synthetic polynucleotide
caggtgcagctggtgcagtctggggctgaggtgaggaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagattcaccatgaccaggaacacctccataagcacagcctacatggagctgagcagcctgagatctgaggacacggccgtgtattactgtgcctatagcagtggctggtaccgctttgactactggggccagggaaccctggtcaccgtctcctca

SEQ ID NO: 30370 - protein, 118 aa, Artificial Sequence
  Description of Artificial Sequence: Synthetic polypeptide
QVQLVQSGAEVRKPGASVKVSCKASGYTFTNYDINWVRQATGQGLEWMGWMHPNSGNTGYAQKFQGRFTMTRNTSISTAYMELSSLRSEDTAVYYCAYSSGWYRFDYWGQGTLVTVSS

SEQ ID NO: 30371 - DNA, 345 bp, Artificial Sequence
  Description of Artificial Sequence: Synthetic polynucleotide
gaggtgcagctggtggagtctgggggaggcttggtacagcctggggggtccctgagactctcctgtgcagcctctggattcacctttagcagctatgtcatgagctgggtccgccaggctccagggaaggggctggagtgggtctcagctattagtggtagtggtggtaggacagactacgcagactccgtaaagggccggttcaccatctccagagacaattccaagaacacgctgtatctgcaaatgaacagcctgagagccgaggacacggccgtatattactgtgcgaaagggggctggaaccacgactggggccaagggaccacggtcaccgtctcctca

SEQ ID NO: 30372 - protein, 115 aa, Artificial Sequence
  Description of Artificial Sequence: Synthetic polypeptide
EVQLVESGGGLVQPGGSLRLSCAASGFTFSSYVMSWVRQAPGKGLEWVSAISGSGGRTDYADSVKGRFTISRDNSKNTLYLQMNSLRAEDTAVYYCAKGGWNHDWGQGTTVTVSS

SEQ ID NO: 30373 - DNA, 339 bp, Artificial Sequence
  Description of Artificial Sequence: Synthetic polynucleotide
gaggtgcagctggtggagtctgggggaggcctggtcaagccgggggggtccctgagactctcctgtgcagcctctggattcaccttcagtagctatagaatgaactgggtccgccaggctccagggaaggggctggagtgggtctcatccataagtggtagtggtaattacatagactacgcagactcagtgaagggccgattcaccatctccagagacaacgccaagaactcactgtatctgcaaatgaacagcctgagagccgaggacacggctgtgtattactgtgcgagaggttgggacgtctggggccaagggaccacggtcaccgtctcctca

SEQ ID NO: 30374 - protein, 113 aa, Artificial Sequence
  Description of Artificial Sequence: Synthetic polypeptide
EVQLVESGGGLVKPGGSLRLSCAASGFTFSSYRMNWVRQAPGKGLEWVSSISGSGNYIDYADSVKGRFTISRDNAKNSLYLQMNSLRAEDTAVYYCARGWDVWGQGTTVTVSS

SEQ ID NO: 30375 - DNA, 345 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgtacagaagttccagggcagagtcaccatgaccaggaacacctccataagcacagcctacatggagctgagcagcctgagatctgaggacacggccgtgtattactgtgcgagaaagaaaactggggactactggggccagggaaccctggtcaccgtctcctca

SEQ ID NO: 30376 - protein, 115 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYVQKFQGRVTMTRNTSISTAYMELSSLRSEDTAVYYCARKKTGDYWGQGTLVTVSS

SEQ ID NO: 30377 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatcatattctggaaacaataaatactatgcagactccgtgaagggccgattcaccatctccagagacaattccaagaacacgctgtatctgcagttgaacagcctgagagctgaggacatggctgtgtattactgtgcgagacggagcagctcgtgggggggctacggtatggacgtctggggccacgggaccacggtcaccgtctcctca

SEQ ID NO: 30378 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAVISYSGNNKYYADSVKGRFTISRDNSKNTLYLQLNSLRAEDMAVYYCARRSSSWGGYGMDVWGHGTTVTVSS

SEQ ID NO: 30379 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatacactgggtccgccaggctccaggcaaggggctggagtgggtggctgttgtatggtatgatgtaaataataaatactatgcagactccgtgaagggccgattcaccatctccagagacaattccaagaacacgctgtatctgcaaatgaacagcctgagagccgaggacacggctgtgtattactgtgcgagagagctggggttcctctctgactactggggccagggaaccctggtcaccgtctcctca

SEQ ID NO: 30380 - protein, 117 aa, Artificial Sequence
  Description of Artificial Sequence: Synthetic polypeptide
QVQLVESGGGVVQPGRSLRLSCAASGFTFSSYGIHWVRQAPGKGLEWVAVVWYDVNNKYYADSVKGRFTISRDNSKNTLYLQMNSLRAEDTAVYYCARELGFLSDYWGQGTLVTVSS

SEQ ID NO: 30381 - DNA, 369 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcacctttagtgactatgtcatgcagtgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaccgtataatagtggctggtacgactacggtatggacgtctggggccaagggaccacggtcaccgtctcctca

SEQ ID NO: 30382 - protein, 123 aa, Artificial Sequence
  Description of Artificial Sequence: Synthetic polypeptide
QVQLVESGGGVVQPGRSLRLSCAASGFTFSDYVMQWVRQAPGKGLEWVAVIWYDGSNKYYADSVKGRFTISRDNSKNTLYLQMNSLRAEDTAVYYCAREPYNSGWYDYGMDVWGQGTTVTVSS

SEQ ID NO: 30383 - DNA, 369 bp, Artificial Sequence
  Description of Artificial Sequence: Synthetic polynucleotide
caggtgcagctggtggagtctgggggaggcgtggtccagcctgggaggtccctgagactctcctgcgcagcgtctggattcaccttcagtaactatgtcatgcactgtgtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaccgtatagtagtggctggtacgactacggtatggacgtctggggccaagggaccacggtcaccgtctcctca

SEQ ID NO: 30384 - protein, 123 aa, Artificial Sequence
  Description of Artificial Sequence: Synthetic polypeptide
QVQLVESGGGVVQPGRSLRLSCAASGFTFSNYVMHCVRQAPGKGLEWVAVIWYDGSNKYYADSVKGRFTISRDNSKNTLYLQMNSLRAEDTAVYYCAREPYSSGWYDYGMDVWGQGTTVTVSS

SEQ ID NO: 30385 - DNA, 345 bp, Artificial Sequence
  Description of Artificial Sequence: Synthetic polynucleotide
gaggtgcagctggtggagtctgggggaggcctggtcaagcctggggggtccctaagactctcctgtgcagcctctggattcaccttcagtagctataccatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtatattactgtgcgcgagtgagctgggctgactgctggggccagggaaccctggtcaccgtctcctca

SEQ ID NO: 30386 - protein, 115 aa, Artificial Sequence
  Description of Artificial Sequence: Synthetic polypeptide
EVQLVESGGGLVKPGGSLRLSCAASGFTFSSYTMNWVRQAPGKGLEWVSSISGSSSYIYYADSVKGRFTISRDNAKNSLYLQMNSLRAEDTAVYYCARVSWADCWGQGTLVTVSS

SEQ ID NO: 30387 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagttataaatactatgcagactccgtgaagggccgattcaccatctccagagacaattccaagaacacgctgtatcttcaaatgaacagcctgagagccgaggacacggctgtgtattactgtgcgagagaggcctacgatttttggagtggttattatgactactggggccagggaaccctggtcaccgtctcctca

SEQ ID NO: 30388 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSYKYYADSVKGRFTISRDNSKNTLYLQMNSLRAEDTAVYYCAREAYDFWSGYYDYWGQGTLVTVSS

SEQ ID NO: 30389 - DNA, 339 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgtcatgagctgggtccgccaggctccagggaaggggctggagtgggtctcagctatgagtggtagtggtggtcacacatactacgcagactccgtgaagggccggttcaccatctccagagacaattccaagaacacggtgtatctgcaaatgaacagcctgagagccgaggacacggccgtatattactgtgtgaaacatggatacagctggggccagggaaccctggtcaccgtctcctca

SEQ ID NO: 30390 - protein, 113 aa, Artificial Sequence
  Description of Artificial Sequence: Synthetic polypeptide
EVQLLESGGGLVQPGGSLRLSCAASGFTFSSYVMSWVRQAPGKGLEWVSAMSGSGGHTYYADSVKGRFTISRDNSKNTVYLQMNSLRAEDTAVYYCVKHGYSWGQGTLVTVSS

SEQ ID NO: 30391 - DNA, 339 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatcgcatgaactgggtccgccaggctccagggaaggggctggagtgggtctcatccattagtagtagtactggttacatgtactacgcagactcagtgaagggccgattcaccatctccagagacaacgccaagaactcactgtatctgcaaatgaacagcctgagagccgaggacacggctgtgtatttctgtgcgagagataaagattactggggccagggaaccctggtcaccgtctcctca

SEQ ID NO: 30392 - protein, 113 aa, Artificial Sequence
  Description of Artificial Sequence: Synthetic polypeptide
EVQLVESGGGLVKPGGSLRLSCAASGFTFSSYRMNWVRQAPGKGLEWVSSISSSTGYMYYADSVKGRFTISRDNAKNSLYLQMNSLRAEDTAVYFCARDKDYWGQGTLVTVSS

SEQ ID NO: 30393 - DNA, 342 bp, Artificial Sequence; identical to SEQ ID NO: 30355
  Description of Artificial Sequence: Synthetic polynucleotide

SEQ ID NO: 30394 - protein, 114 aa, Artificial Sequence; identical to SEQ ID NO: 30356
  Description of Artificial Sequence: Synthetic polypeptide

SEQ ID NO: 30395 - DNA, 339 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgtcatgagctgggtccgccagactccagggaagggactggagtgggtctcagctatgagtggtagtggtggtcacacatactacgcagactccgtgaagggccggttcaccatctccagagacaattccaagaacacgctgtatctgcaaatgaacagcctgagagccgaggacacggccatatattactgtgtgaaacatggatacagctggggccagggaaccctggtcaccgtctcctca

SEQ ID NO: 30396 - protein, 113 aa, Artificial Sequence
  Description of Artificial Sequence: Synthetic polypeptide
EVQLLESGGGLVQPGGSLRLSCAASGFTFSSYVMSWVRQTPGKGLEWVSAMSGSGGHTYYADSVKGRFTISRDNSKNTLYLQMNSLRAEDTAIYYCVKHGYSWGQGTLVTVSS

SEQ ID NO: 30397 - DNA, 357 bp, Artificial Sequence
  Description of Artificial Sequence: Synthetic polynucleotide
cagctgcagctgcaggagtcgggcccaggactggtgaagccttcggagaccctgtccctcacctgcaccgtctctggtggctccatcagcagaagtagttactactggggctggatccgccagcccccagggaagggactggagtggattgggagtatctattatagtgggagtacctcctacaacccgtctctcgagagtcgagttaccatatccgtagacacgtccaagaaccagttctccctgaagctgagctctgtgaccgccgccgacacggctgtgttttactgtgcgagactctctcaacggtgggactttgactactggggccagggaaccctggtcaccgtctcctca

SEQ ID NO: 30398 - protein, 119 aa, Artificial Sequence
  Description of Artificial Sequence: Synthetic polypeptide
QLQLQESGPGLVKPSETLSLTCTVSGGSISRSSYYWGWIRQPPGKGLEWIGSIYYSGSTSYNPSLESRVTISVDTSKNQFSLKLSSVTAADTAVFYCARLSQRWDFDYWGQGTLVTVSS

SEQ ID NO: 30399 - DNA, 354 bp, Artificial Sequence
  Description of Artificial Sequence: Synthetic polynucleotide
caggtgcagctggtgcagtctgggactgaggtgaagaagcctggggcctcagtgaaggtctcctgcaaggcttctggatacaccttcaccaattatgatatcaactgggtgcgacaggccactggacaaggacctgagtggatgggatggatgcaccctaacagtggtaacacaggctatccacagaagttccagggcagagtcaccatgaccaggaacacctccataagcacagcctacatggagctgagcagcctgagatctgaggacacggccgtgtattactgtgcgtatagcagcggctggtacatttttgactactggggccagggaaccctggtcaccgtctcctca

SEQ ID NO: 30400 - protein, 118 aa, Artificial Sequence
  Description of Artificial Sequence: Synthetic polypeptide
QVQLVQSGTEVKKPGASVKVSCKASGYTFTNYDINWVRQATGQGPEWMGWMHPNSGNTGYPQKFQGRVTMTRNTSISTAYMELSSLRSEDTAVYYCAYSSGWYIFDYWGQGTLVTVSS

SEQ ID NO: 30401 - DNA, 369 bp, Artificial Sequence; identical to SEQ ID NO: 30381
  Description of Artificial Sequence: Synthetic polynucleotide

SEQ ID NO: 30402 - protein, 123 aa, Artificial Sequence; identical to SEQ ID NO: 30382
  Description of Artificial Sequence: Synthetic polypeptide

SEQ ID NO: 30403 - DNA, 342 bp, Artificial Sequence; identical to SEQ ID NO: 30343
  Description of Artificial Sequence: Synthetic polynucleotide

SEQ ID NO: 30404 - protein, 114 aa, Artificial Sequence; identical to SEQ ID NO: 30344
  Description of Artificial Sequence: Synthetic polypeptide

SEQ ID NO: 30405 - DNA, 345 bp, Artificial Sequence
  Description of Artificial Sequence: Synthetic polynucleotide
gaggtgcagctggtggagtctgggggaggcctggtcaagtctggggggtccctgagactctcctgtgcagcctctggattcaccttcagtagctataggatgaactgggtccgccaggctccagggaaggggctggagtgggtctcatccattagtggtagtagtagttacatagactacgcagactcagtgaagggccgattcaccatctccagagacaacgccaagaactcactgtatctgcaaatgaacagcctgagagccgaggacacggctgtgtattactgtgcgagaaagagttggtttgactactggggccagggaaccctggtcaccgtctcctca

SEQ ID NO: 30406 - protein, 115 aa, Artificial Sequence
  Description of Artificial Sequence: Synthetic polypeptide
EVQLVESGGGLVKSGGSLRLSCAASGFTFSSYRMNWVRQAPGKGLEWVSSISGSSSYIDYADSVKGRFTISRDNAKNSLYLQMNSLRAEDTAVYYCARKSWFDYWGQGTLVTVSS

SEQ ID NO: 30407 - DNA, 357 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtagaagtagctactactggggctggatccgccagtacccagggaaggggctggagtggattgggaatatctattatagtgggagcgcctaccacattccgtccctcaagagtcgagtcaccatatccgtagacacgtccaagaaccagttctccctgaagttgaactctgtgaccgccgcagacacggctgtgtattactgtgtgagacatgacccaaactggggagttgactactggggccagggaaccctggtcaccgtctcctca

SEQ ID NO: 30408 - protein, 119 aa, Artificial Sequence
  Description of Artificial Sequence: Synthetic polypeptide
QLQLQESGPGLVKPSETLSLTCTVSGGSISRSSYYWGWIRQYPGKGLEWIGNIYYSGSAYHIPSLKSRVTISVDTSKNQFSLKLNSVTAADTAVYYCVRHDPNWGVDYWGQGTLVTVSS

SEQ ID NO: 30409 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctttggcatgcactgggtccgccaggctccaggcaagggcctggagtgggtggcagtcatatggtatgatggaagttataaatactatgcagactccgtgaagggccgattcaccatctccagagacaattccaagaacacgctgtatctgcaaatgaacagcctgagagccgaggacacggctgtgtattactgtgcgagagttggtatagaagtggctggtgactactacttcggtatggaagtctggggccaagggaccacggtcaccgtctcctca

SEQ ID NO: 30410 - protein, 124 aa, Artificial Sequence
  Description of Artificial Sequence: Synthetic polypeptide
QVQLVESGGGVVQPGRSLRLSCAASGFTFSSFGMHWVRQAPGKGLEWVAVIWYDGSYKYYADSVKGRFTISRDNSKNTLYLQMNSLRAEDTAVYYCARVGIEVAGDYYFGMEVWGQGTTVTVSS

SEQ ID NO: 30411 - DNA, 354 bp, Artificial Sequence
  Description of Artificial Sequence: Synthetic polynucleotide
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttataccggtggtagcacatacaacgcagactccgtgaagggccgattcaccatctccagagacaattccaagaacacgctgtatcttcaaatgaacagcctgagagccgaggacacggccgtgtattactgtgcgagaaattggggaatggctggcccctttgactactggggccagggaaccctggtcaccgtctcctca

SEQ ID NO: 30412 - protein, 118 aa, Artificial Sequence
  Description of Artificial Sequence: Synthetic polypeptide
EVQLVESGGGLIQPGGSLRLSCAASGFTVSSNYMSWVRQAPGKGLEWVSVIYTGGSTYNADSVKGRFTISRDNSKNTLYLQMNSLRAEDTAVYYCARNWGMAGPFDYWGQGTLVTVSS

SEQ ID NO: 30413 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcatatggtggaagtaataaataccatgcagactccgtgaagggccgattcaccatctccagagacaattccaagaacacgctgtatctgcaaatgaacagcctgagagctgaggacacggctgtgtattactgtgtgagacggagcagctcgtcggggggctacggtatggacgtctggggccaagggaccacggtcaccgtctcctca

SEQ ID NO: 30414 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYGGSNKYHADSVKGRFTISRDNSKNTLYLQMNSLRAEDTAVYYCVRRSSSSGGYGMDVWGQGTTVTVSS

SEQ ID NO: 30415 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactttggcttgcactgggtccgccaggctccaggccagggactggagtgggtggcagttatatggtttgatggaagtaataaatactatgcagactccgtgaagggccgattcaccattttcagagacaattccaagaacacgctgtatctgcaaatgaacagcctgagagccgaggacacggctgtgtattactgtgcgagagagattggctggctctctgactactggggccagggaaccctggtcaccgtctcctca

SEQ ID NO: 30416 - protein, 117 aa, Artificial Sequence
  Description of Artificial Sequence: Synthetic polypeptide
QVQLVESGGGVVQPGRSLRLSCAASGFTFSDFGLHWVRQAPGQGLEWVAVIWFDGSNKYYADSVKGRFTIFRDNSKNTLYLQMNSLRAEDTAVYYCAREIGWLSDYWGQGTLVTVSS

SEQ ID NO: 30417 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggaatgggtggcaattatatcatattctggaagaaatgatttctatgcagactccgtgaagggccgattcaccatctccagagacaattccaagaacacgctgtatctgcaaatgaacagcctgagagctgaggacacggctgtgtattactgtgcgagacgtatagcagcagctggtcactacggtatggacgtctggggccaagggaccacggtcaccgtctcctca

SEQ ID NO: 30418 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIISYSGRNDFYADSVKGRFTISRDNSKNTLYLQMNSLRAEDTAVYYCARRIAAAGHYGMDVWGQGTTVTVSS

SEQ ID NO: 30419 - DNA, 351 bp, Artificial Sequence; identical to SEQ ID NO: 30415
  Description of Artificial Sequence: Synthetic polynucleotide

SEQ ID NO: 30420 - protein, 117 aa, Artificial Sequence; identical to SEQ ID NO: 30416
  Description of Artificial Sequence: Synthetic polypeptide

SEQ ID NO: 30421 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcacctttagtgactatgtcatgcagtgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaccgtataatagtggctggtacgactacggtatggacgtctggggccaagggaccacggtcaccgtctcctca

SEQ ID NO: 30422 - protein, 123 aa, Artificial Sequence; identical to SEQ ID NO: 30382
  Description of Artificial Sequence: Synthetic polypeptide

SEQ ID NO: 30423 - DNA, 342 bp, Artificial Sequence
  Description of Artificial Sequence: Synthetic polynucleotide
gaggtgcaactggtggagtctgggggaggcctggtcaagcctggggggtccctgagattctcctgtgcagcctctggattcaccttcagtagttatagcatgaactgggtccgccaggctccagggaaggggctggagtgggtctcatccattagtggtagtagtacgtacatatactacgcagactcagtgaagggccgattcaccatctccagagacaacgccaagaactcactgtatctgcaaatgaacagcctgagagccgaagacacggctgtgtattactgcgcgagagatcggggcagcagctggggccagggaaccctggtcaccgtctcctca

SEQ ID NO: 30424 - protein, 114 aa, Artificial Sequence; identical to SEQ ID NO: 30344
  Description of Artificial Sequence: Synthetic polypeptide

SEQ ID NO: 30425 - DNA, 342 bp, Artificial Sequence
  Description of Artificial Sequence: Synthetic polynucleotide
gaggtgcaactggtggagtctgggggaggcctggtcaagcctggggggtccttgagattctcctgtgcagcctctggattcaccttcagtagttatagcatgaaccgggtccgccaggctccagggaaggggctggagtgggtctcatccattagtggtagtagtacgtacatatactacgcagactcagtgaagggccgattcaccatctccagagacaacgccaagaactcactgtatctgcaaatgaacagcctgagagccgaagacacggctgtgtattactgcgcgagagatcggggcagcagctggggccagggaaccctggtcaccgtctcctca

SEQ ID NO: 30426 - protein, 114 aa, Artificial Sequence
  Description of Artificial Sequence: Synthetic polypeptide
EVQLVESGGGLVKPGGSLRFSCAASGFTFSSYSMNRVRQAPGKGLEWVSSISGSSTYIYYADSVKGRFTISRDNAKNSLYLQMNSLRAEDTAVYYCARDRGSSWGQGTLVTVSS

SEQ ID NO: 30427 - DNA, 354 bp, Artificial Sequence
  Description of Artificial Sequence: Synthetic polynucleotide
caggtgcagctggtgcagtctgggtctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccatagacacagcctacatggaactgagcagcctgagttctgaggacacggccgtgtatttctgtgcgtttagcagtggctggtacttctttgactactggggccagggaaccctggtcaccgtctcctca

SEQ ID NO: 30428 - protein, 118 aa, Artificial Sequence
  Description of Artificial Sequence: Synthetic polypeptide
QVQLVQSGSEVKKPGASVKVSCKASGYTFTNYDINWVRQATGQGLEWMGWMHPNSGNTGYAQKFQGRVTMTRNTSIDTAYMELSSLSSEDTAVYFCAFSSGWYFFDYWGQGTLVTVSS

SEQ ID NO: 30429 - DNA, 354 bp, Artificial Sequence; identical to SEQ ID NO: 30369
  Description of Artificial Sequence: Synthetic polynucleotide

SEQ ID NO: 30430 - protein, 118 aa, Artificial Sequence; identical to SEQ ID NO: 30370
  Description of Artificial Sequence: Synthetic polypeptide

SEQ ID NO: 30431 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaataactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagaaaaggtatagcagcagttggagactactactacggtatggacgtctggggccaagggaccacggtcaccgtctcctca

SEQ ID NO: 30432 - protein, 124 aa, Artificial Sequence
  Description of Artificial Sequence: Synthetic polypeptide
QVQLVESGGGVVQPGRSLRLSCAASGFTFNNYGMHWVRQAPGKGLEWVAVIWYDGSNKYYADSVKGRFTISRDNSKNTLYLQMNSLRAEDTAVYYCARKGIAAVGDYYYGMDVWGQGTTVTVSS

SEQ ID NO: 30433 - DNA, 345 bp, Artificial Sequence
  Description of Artificial Sequence: Synthetic polynucleotide
gaggtgcagctggtggactctgggggaggcctggtcaagcctggggggtccctgagactctcctgtgcagcctctggattcaccttcagtagctatagcatgaactgggtccgccaggctccagggaaggggctggagtgggtctcatccattagtggtagtggtagttacatatactacgcagactcagtgaagggccgattcaccacctccagagacaacgccaagaactcactgtatctgcaaatgaacagcctgagcgccgacgacacggctgtttattactgtacgctctatagcagctcgcactattggggccagggaaccctggtcaccgtctcctca

SEQ ID NO: 30434 - protein, 115 aa, Artificial Sequence
  Description of Artificial Sequence: Synthetic polypeptide
EVQLVDSGGGLVKPGGSLRLSCAASGFTFSSYSMNWVRQAPGKGLEWVSSISGSGSYIYYADSVKGRFTTSRDNAKNSLYLQMNSLSADDTAVYYCTLYSSSHYWGQGTLVTVSS

SEQ ID NO: 30435 - DNA, 342 bp, Artificial Sequence
  Description of Artificial Sequence: Synthetic polynucleotide
gaggtgcaactggtggagtctgggggaggcctggtccagcctggggggtccctgagactctcctgtgcagcctctggattcaccttcagtagctatagcatgaactgggtccgccaggctccagggaaggggctggagtgggtctcctccactagtgggagttctacttacatatactacgcagactcagtgaagggccgattcaccatctccagagacaacgccaagaacttagtgtatctgcaaatgaacagcctgagacccgaggacacggctgtgtattactgtgcgagagatcgaggcagcctctggggccagggaaccctggtcaccgtctcctca

SEQ ID NO: 30436 - protein, 114 aa, Artificial Sequence
  Description of Artificial Sequence: Synthetic polypeptide
EVQLVESGGGLVQPGGSLRLSCAASGFTFSSYSMNWVRQAPGKGLEWVSSTSGSSTYIYYADSVKGRFTISRDNAKNLVYLQMNSLRPEDTAVYYCARDRGSLWGQGTLVTVSS

SEQ ID NO: 30437 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgagctgggtccgccaggctccagggaaggggctggagtgggtctcatccattagtggtagtagtgcttacatatactacgcagactcagtgaagggccgattcaccatctccagagacaacgccaagaactcactgtatctgcaaatgaacagcctgagagccgaggacacggctgtgtattactgtgcgagattgagcggtatggacgtctggggccaagggaccacggtcaccgtctcctca

SEQ ID NO: 30438 - protein, 115 aa, Artificial Sequence
  Description of Artificial Sequence: Synthetic polypeptide
EVQLVESGGGLVKPGGSLRLSCAASGFTFSSYSMSWVRQAPGKGLEWVSSISGSSAYIYYADSVKGRFTISRDNAKNSLYLQMNSLRAEDTAVYYCARLSGMDVWGQGTTVTVSS

SEQ ID NO: 30439 - DNA, 342 bp, Artificial Sequence
  Description of Artificial Sequence: Synthetic polynucleotide
gaggtgcagctggtggagtctgggggaggcctggtccagccgggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgattcaccatctccagagacaacgccaagaactcactgtatctgcaaatgaacagcctgagagccgaggacacggctgtgtattactgtgcgagagatcgaggcagcctctggggccagggaaccctggtcaccgtctcctca

SEQ ID NO: 30440 - protein, 114 aa, Artificial Sequence
  Description of Artificial Sequence: Synthetic polypeptide
EVQLVESGGGLVQPGGSLRLSCAASGFTFSSYSMNWVRQAPGKGLEWVSSISGSSTYIYYADSVKGRFTISRDNAKNSLYLQMNSLRAEDTAVYYCARDRGSLWGQGTLVTVSS

SEQ ID NO: 30441 - DNA, 342 bp, Artificial Sequence
  Description of Artificial Sequence: Synthetic polynucleotide
gaggtgcagttggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgattcaccatctccagagacaacgccaagaactcactgtatctgcaaatgaacagcctgagagccgaggacacggctgtgtattactgtgcgagagcccgtatggacgtctggggccaagggaccacggtcaccgtctcctca

SEQ ID NO: 30442 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSTYIYYADSVKGRFTISRDNAKNSLYLQMNSLRAEDTAVYYCARARMDVWGQGTTVTVSS

SEQ ID NO: 30443 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcacccattatgatatcaactgggtgcgacaggccactggacaagggcttgagtgggtggggtggatgcaccctaacagtcataagacaggctatgcacagaagttccagggcagagtcaccatgaccaggaacacctccaacagcacagcctacatggacctcagcagcctgagatctgaggacacggccgtgtattactgtgcttatagcagtggctggtacatgtttgactactggggccagggaaccctggtcaccgtctcctca

SEQ ID NO: 30444 - protein, 118 aa, Artificial Sequence
  Description of Artificial Sequence: Synthetic polypeptide
QVQLVQSGAEVKKPGASVKVSCKASGYTFTHYDINWVRQATGQGLEWVGWMHPNSHKTGYAQKFQGRVTMTRNTSNSTAYMDLSSLRSEDTAVYYCAYSSGWYMFDYWGQGTLVTVSS

SEQ ID NO: 30445 - DNA, 345 bp, Artificial Sequence
  Description of Artificial Sequence: Synthetic polynucleotide
gaggtgcagctggtggagtctgggggagccctggtcaagcctggggggtccctgagactctcctgtgcagcctctggattcaccttcagtagctatagcatgagctgggtccgccaggctccagggaaggggctggggtgggtctcatccattagtgggagtagtagttacagttactacgcagactcagtgaagggccgattcaccatctccagagacaatgccaagaactcactgtatctgcaaatgaacagcctgagagccgaggacacggctgtgtattactgtgcgagactaactggctttgactactggggccagggaaccctggtcaccgtctcctca

SEQ ID NO: 30446 - protein, 115 aa, Artificial Sequence
  Description of Artificial Sequence: Synthetic polypeptide
EVQLVESGGALVKPGGSLRLSCAASGFTFSSYSMSWVRQAPGKGLGWVSSISGSSSYSYYADSVKGRFTISRDNAKNSLYLQMNSLRAEDTAVYYCARLTGFDYWGQGTLVTVSS

SEQ ID NO: 30447 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcacctttagtagctttggcatgcactgggtccgccaggctccaggcaagggcctggagtgggtggcagtcatatggtatgatggaacttataaatactatgcagactccgtgaagggccgattcaccatctccagagacaattccaagaacacgctgtatctgcaaatgaacagcctgagagccgaggacacggctgtgtattactgtgcgagagttggtattgaagtggctggtgactactactacggtatggaagtctggggccaagggaccacggtcaccgtctcctca

SEQ ID NO: 30448 - protein, 124 aa, Artificial Sequence
  Description of Artificial Sequence: Synthetic polypeptide
QVQLVESGGGVVQPGRSLRLSCAASGFTFSSFGMHWVRQAPGKGLEWVAVIWYDGTYKYYADSVKGRFTISRDNSKNTLYLQMNSLRAEDTAVYYCARVGIEVAGDYYYGMEVWGQGTTVTVSS

SEQ ID NO: 30449 - DNA, 372 bp, Artificial Sequence
  Description of Artificial Sequence: Synthetic polynucleotide
caggtgcagttggtggagtctgggggaggcgtggtccagcctgggaggtcccagagactctcctgtgcagcgtctggattcacctttagtagctttggcatgcactgggtccgccaggctccaggcaagggcctggagtgggtggcagtcatatggtatgatggaagttataagtaccatgcagactccgtgaagggccgattcaccatctccagagacaattccaagaacacgctgtatctgcaaatgaacagcctgagagccgaggacacggctgtgtattactgtgcgagagttggtatagaagtggctggtgactactactacggtatggaagtctggggccaagggaccacggtcaccgtctcctca

SEQ ID NO: 30450 - protein, 124 aa, Artificial Sequence
  Description of Artificial Sequence: Synthetic polypeptide
QVQLVESGGGVVQPGRSQRLSCAASGFTFSSFGMHWVRQAPGKGLEWVAVIWYDGSYKYHADSVKGRFTISRDNSKNTLYLQMNSLRAEDTAVYYCARVGIEVAGDYYYGMEVWGQGTTVTVSS

SEQ ID NO: 30451 - DNA, 345 bp, Artificial Sequence
  Description of Artificial Sequence: Synthetic polynucleotide
gaggtgcagctgttggagtctgggggaggcttggtacagccgggggggtccctgagactctcctgtgcagcctctggattcacctttagtagctatgtcatgagctgggtccgccaggctccagggaaggggctggagtgggtctcagctatgagtggtagtggtggtagaacatactacgcagactccgtgaagggccggttcaccatctccagagacaattccaagaacacgctgtatctgcaaatgaacagcctgagagccgaggacacggccgtgtattactgtgcgaagtatacctggaacggctactggggccagggaaccctggtcaccgtctcctca

SEQ ID NO: 30452 - protein, 115 aa, Artificial Sequence
  Description of Artificial Sequence: Synthetic polypeptide
EVQLLESGGGLVQPGGSLRLSCAASGFTFSSYVMSWVRQAPGKGLEWVSAMSGSGGRTYYADSVKGRFTISRDNSKNTLYLQMNSLRAEDTAVYYCAKYTWNGYWGQGTLVTVSS

SEQ ID NO: 30453 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaggggccgattcaccatctccagagacaattccaagaacacgctgtatctgcaaatgaacagcctgagagccgaagacacggctgtgtattactgtgcgagagatcccttacgtggatacaatgacccggttatggactactggggccagggaaccctggtcaccgtctcctca

SEQ ID NO: 30454 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVRGRFTISRDNSKNTLYLQMNSLRAEDTAVYYCARDPLRGYNDPVMDYWGQGTLVTVSS

SEQ ID NO: 30455 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagttggatccggcagcccgccgggaagggactggagtggattgggcgtatcgataccagtgggatcaccaactacaacccctccctcaagagtcgagtcaccatgtcaatagacacgtccaagagccagatctccctgaagctgagctctgtgaccgccgcggacacggccgtgtattactgtgcgagagagggaggagtgggagctacctactttgactactggggccagggaaccctggtcaccgtctcctca

SEQ ID NO: 30456 - protein, 119 aa, Artificial Sequence
  Description of Artificial Sequence: Synthetic polypeptide
QVQLQESGPGLVKPSETLSLTCTVSGGSISSYYWSWIRQPAGKGLEWIGRIDTSGITNYNPSLKSRVTMSIDTSKSQISLKLSSVTAADTAVYYCAREGGVGATYFDYWGQGTLVTVSS

SEQ ID NO: 30457 - DNA, 369 bp, Artificial Sequence
  Description of Artificial Sequence: Synthetic polynucleotide
gaggtgcaactggtggagtctgggggaggcttggtacagccgggggggtccctgagactctcctgtgcagcctcaggattcaccttcagtggccatagcatgaactgggtccgccaggctccagggaaggggctggagtgggttgcatacattagccttagtggtagtaccataaagtacgcagactctgtgaagggccgattcaccatctccagagacaatgccagggactcactgtatctgcaaatgaacagcctgagagacgaggacacggctgtgtattactgtgcgagaagggggattactgtggttcggaatgaggacggtttggacgtctggggccaagggaccacggtcaccgtctcctca

SEQ ID NO: 30458 - protein, 123 aa, Artificial Sequence
  Description of Artificial Sequence: Synthetic polypeptide
EVQLVESGGGLVQPGGSLRLSCAASGFTFSGHSMNWVRQAPGKGLEWVAYISLSGSTIKYADSVKGRFTISRDNARDSLYLQMNSLRDEDTAVYYCARRGITVVRNEDGLDVWGQGTTVTVSS

SEQ ID NO: 30459 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtgtcaattatatggtatgatggaactaataaatactatgcagactccgtgaagggccgattcaccatctccagagacaattccaagaacacgctgtatctgcaactgaacagcctgagagccgaggacacggctgtgtattactgtgcgcgagatcccttacgtggatacaatgacccggttatggactactggggccagggaaccctggtcaccgtctcctca

SEQ ID NO: 30460 - protein, 122 aa, Artificial Sequence
  Description of Artificial Sequence: Synthetic polypeptide
QVQLVESGGGVVQPGRSLRLSCAASGFTFSTYGMHWVRQAPGKGLEWVSIIWYDGTNKYYADSVKGRFTISRDNSKNTLYLQLNSLRAEDTAVYYCARDPLRGYNDPVMDYWGQGTLVTVSS

SEQ ID NO: 30461 - DNA, 357 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagttggatccggcagcccgccgggaagggactggagtggattgggcgtatcgataccagtgggatcaccaactacaacccctccctcaagagtcgagtcaccatgtcagtagacacgtccaagagccagatctccctgaagctgagctctgtgaccgccgcggacacggccgtgtattactgtgcgagagagggaggagtgggagctacctactttgactactggggccagggaaccctggtcaccgtctcctca

SEQ ID NO: 30462 - protein, 119 aa, Artificial Sequence
  Description of Artificial Sequence: Synthetic polypeptide
QVQLQESGPGLVKPSETLSLTCTVSGGSISSYYWSWIRQPAGKGLEWIGRIDTSGITNYNPSLKSRVTMSVDTSKSQISLKLSSVTAADTAVYYCAREGGVGATYFDYWGQGTLVTVSS

SEQ ID NO: 30463 - DNA, 369 bp, Artificial Sequence
  Description of Artificial Sequence: Synthetic polynucleotide
gaggtgcaactggtggagtctgggggaggcttggtacagcctggggggtccctgagactctcctgtgcagcctcaggattcaccttcagtggccatagcatgaactgggtccgccaggctccagggaaggggctggagtgggttgcatacattagcattagtagtagtaccataaagtacgcagactctgtgaagggccgattcaccatctccagagacaatgccagggactcactgtatctgcaaatgaacagcctgagagacgaggacacggctgtgtattactgtgcgagaagggggattactgtggttcggaatgaggacggtttggacgtctggggccaagggaccacggtcaccgtctcctca

SEQ ID NO: 30464 - protein, 123 aa, Artificial Sequence
  Description of Artificial Sequence: Synthetic polypeptide
EVQLVESGGGLVQPGGSLRLSCAASGFTFSGHSMNWVRQAPGKGLEWVAYISISSSTIKYADSVKGRFTISRDNARDSLYLQMNSLRDEDTAVYYCARRGITVVRNEDGLDVWGQGTTVTVSS

SEQ ID NO: 30465 - DNA, 354 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggacctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtatttctgtgcgaaagtcgggaggtactactacggtatggacgtctggggccaagggaccacggtcaccgtctcctca

SEQ ID NO: 30466 - protein, 118 aa, Artificial Sequence
  Description of Artificial Sequence: Synthetic polypeptide
QVQLQESGPGLVKPSETLSLTCTVSGGSISSYYWTWIRQPAGKGLEWIGRIYTSGSTNYNPSLKSRVTMSVDTSKNQFSLKLSSVTAADTAVYFCAKVGRYYYGMDVWGQGTTVTVSS

SEQ ID NO: 30467 - DNA, 366 bp, Artificial Sequence
  Description of Artificial Sequence: Synthetic polynucleotide
caggtgcagctggtgcagtctggggctgaggtgaagaagcctggggcctcagtgagggtctcctgcaaggcttctggatacaccttcaccggctactttatgcactgggtgcgacaggcccctggacaagggcttgagtggatgggatggatcaagcctaagagtggtggcacaaactctgcacagaggtttcagggcagggtcaccatgaccagggacacgtccatcaacacagcctacatggagctgaacaggctgagatctgacgacacggccgtgtattactgtgcgagaggggggactacggtggctacgtggggggtctttgactactggggccagggaaccctggtcaccgtctcctca

SEQ ID NO: 30468 - protein, 122 aa, Artificial Sequence
  Description of Artificial Sequence: Synthetic polypeptide
QVQLVQSGAEVKKPGASVRVSCKASGYTFTGYFMHWVRQAPGQGLEWMGWIKPKSGGTNSAQRFQGRVTMTRDTSINTAYMELNRLRSDDTAVYYCARGGTTVATWGVFDYWGQGTLVTVSS

SEQ ID NO: 30469 - DNA, 345 bp, Artificial Sequence
  Description of Artificial Sequence: Synthetic polynucleotide
gaggtgcagttgttggagtctgggggaggcttggtgcagtctggggggtccctgagactctcctgtgcagcctctggattcacctttagcagctatgtcatgagttgggtccgccaggctccagggaaggggctggagtgggtctcagctattagtggtagtggtagtagaatatactacgcggactccgtgaagggccggttcaccatctccagagacaattccaagaacacgctgtatctgcaaatgaacagcctgagagccgaggacacggccttatattactgtgcgagagtggctttctttgactattggggccagggaaccctggtcaccgtctcctca

SEQ ID NO: 30470 - protein, 115 aa, Artificial Sequence
  Description of Artificial Sequence: Synthetic polypeptide
EVQLLESGGGLVQSGGSLRLSCAASGFTFSSYVMSWVRQAPGKGLEWVSAISGSGSRIYYADSVKGRFTISRDNSKNTLYLQMNSLRAEDTALYYCARVAFFDYWGQGTLVTVSS

SEQ ID NO: 30471 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaattgaacagcctgagagccgaggacacggctgtgtattactgtgcgagagaaaggtatagcagtggctggtacgactacggtatggacgtctggggccaagggaccacggtcaccgtctcctca

SEQ ID NO: 30472 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVAVIWYDGSNKYYADSVKGRFTISRDNSKNTLYLQLNSLRAEDTAVYYCARERYSSGWYDYGMDVWGQGTTVTVSS

SEQ ID NO: 30473 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagttataaatactatgcagattccgtgaagggccgattcaccatctccagagacaattccaagaacacactgtatctgcaaatgaacagcctgagagccgaggacacggctgtgtattactgtgcgagagatgcccacgatttttggagtggttactttgactcctggggccagggaaccctggtcaccgtctcctca

SEQ ID NO: 30474 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSYKYYADSVKGRFTISRDNSKNTLYLQMNSLRAEDTAVYYCARDAHDFWSGYFDSWGQGTLVTVSS

SEQ ID NO: 30475 - DNA, 345 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttagcagctatgtcatgagttgggtccgccaggctccagggaaggggctggagtgggtctcagctattagtggtagtggtaatagaatatactacgcagactccgtgaagggccggttcaccatctccagagacaattccaagaacacgctgtatctgcaaatgaacagcctgagagccgaggacacggccttatattactgtgcgagagtggctttctttgactattggggccagggaaccctggtcaccgtctcctca

SEQ ID NO: 30476 - protein, 115 aa, Artificial Sequence
  Description of Artificial Sequence: Synthetic polypeptide
EVQLLESGGGLVQPGGSLRLSCAASGFTFSSYVMSWVRQAPGKGLEWVSAISGSGNRIYYADSVKGRFTISRDNSKNTLYLQMNSLRAEDTALYYCARVAFFDYWGQGTLVTVSS

SEQ ID NO: 30477 - DNA, 354 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttattactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagtcgggaggtactactatggtatggacgtctggggccaagggaccacggtcaccgtctcctca

SEQ ID NO: 30478 - protein, 118 aa, Artificial Sequence
  Description of Artificial Sequence: Synthetic polypeptide
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARVGRYYYGMDVWGQGTTVTVSS

SEQ ID NO: 30479 - DNA, 369 bp, Artificial Sequence
  Description of Artificial Sequence: Synthetic polynucleotide
caggtgcagctggtggaatctgggggaggcgtggtccagcctgggaggtccctgagactctcctgtgcagcgtctggattctccttcagtgactatgtcatgcactgggtccgccaggctccaggcaaggggctggagtgggtggcagttatatggtatgatggaagtaataaatactatgaagactccgtgaagggccgattcaccatctccagagacaattccaagaacacgctgtatctgcaaatgaacagcctgagagccgaggacacggctgtgtattactgtgcgagagagacgtatagcagcagctggtacgactacggtatggacgtctggggccaagggaccacggtcaccgtctcctca

SEQ ID NO: 30480 - protein, 123 aa, Artificial Sequence
  Description of Artificial Sequence: Synthetic polypeptide
QVQLVESGGGVVQPGRSLRLSCAASGFSFSDYVMHWVRQAPGKGLEWVAVIWYDGSNKYYEDSVKGRFTISRDNSKNTLYLQMNSLRAEDTAVYYCARETYSSSWYDYGMDVWGQGTTVTVSS

SEQ ID NO: 30481 - DNA, 366 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtacctatggcatgcactgggtccgccaggctccaggcaaggggctggagtgggtgtcaattatatggtatgatggaactaataaatactatgcagactccgtgaagggccgattcaccatctccagagacaattccaagaacacgctgtttctgcaactgaacagcctgagagccgaggacacggctatgtattactgtgcgcgagatcccttacgtggatacaatgacccggttatggactactggggccagggaaccctggtcaccgtctcctca

SEQ ID NO: 30482 - protein, 122 aa, Artificial Sequence
  Description of Artificial Sequence: Synthetic polypeptide
QVQLVESGGGVVQPGRSLRLSCTASGFTFSTYGMHWVRQAPGKGLEWVSIIWYDGTNKYYADSVKGRFTISRDNSKNTLFLQLNSLRAEDTAMYYCARDPLRGYNDPVMDYWGQGTLVTVSS

SEQ ID NO: 30483 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaactaataaatactatgcagactccgtgaagggccgattcaccatctccagagacaattccaagaacacgctgtatctgcaactgaacagcctgagagccgaggacacggctgtgtattactgtgcgcgagatcccttacgtggatacaatgacccggttatggactactggggccagggaaccctggtcaccgtctcctca

SEQ ID NO: 30484 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGTNKYYADSVKGRFTISRDNSKNTLYLQLNSLRAEDTAVYYCARDPLRGYNDPVMDYWGQGTLVTVSS

SEQ ID NO: 30485 - DNA, 366 bp, Artificial Sequence
  Description of Artificial Sequence: Synthetic polynucleotide
caggtgcagctggtggagtctgggggaggcgtggtccagcctggggggtccctgagactctcctgtgcagcgtctggcttcaccttcagtacctatggcatgcactgggtccgccaggctccaggcaaggggctggagtgggtgacaattatatggtatgatgggactaataaatactatgcagactccgtgaagggccgattcaccatctccagagacaattccaagagcacgctgtatctgcaaatgaacagcctgagagccgaggacacggctgtgtatttctgtgcgagagatcccttacgtggatacaatgacccggttatggactactggggccagggaaccctggtcaccgtctcctca

SEQ ID NO: 30486 - protein, 122 aa, Artificial Sequence
  Description of Artificial Sequence: Synthetic polypeptide
QVQLVESGGGVVQPGGSLRLSCAASGFTFSTYGMHWVRQAPGKGLEWVTIIWYDGTNKYYADSVKGRFTISRDNSKSTLYLQMNSLRAEDTAVYFCARDPLRGYNDPVMDYWGQGTLVTVSS

SEQ ID NO: 30487 - DNA, 366 bp, Artificial Sequence
  Description of Artificial Sequence: Synthetic polynucleotide
caggtgcagctggtgcagtctggggctgaggtgaagaagcctggggcctcagtgagggtctcctgcaaggcttctggatacaccttcaccggctactttatacactgggtgcgacaggcccctggacaagggcttgagtggatgggatggatcaagcctaacagtggtggcacaaactctgcacagaggtttcagggcagggtcaccatgaccagggacacgtccatcaacacagcctacatggagctgaacaggctgagatctgacgacacggccgtgtattactgtgcgagaggggggactacggtggctacgtggggggtctttgactactggggccagggaaccctggtcaccgtctcctca

SEQ ID NO: 30488 - protein, 122 aa, Artificial Sequence
  Description of Artificial Sequence: Synthetic polypeptide
QVQLVQSGAEVKKPGASVRVSCKASGYTFTGYFIHWVRQAPGQGLEWMGWIKPNSGGTNSAQRFQGRVTMTRDTSINTAYMELNRLRSDDTAVYYCARGGTTVATWGVFDYWGQGTLVTVSS

SEQ ID NO: 30489 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccaggacagagtcaccatgaccaggcacacctccataagcacagcctacatggagctgagcagcctgagatctgaggacacggccgtgtattactgtgcgattagcagtggctggtactggttcgacccctggggccagggaaccctggtcaccgtctcctca

SEQ ID NO: 30490 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQDRVTMTRHTSISTAYMELSSLRSEDTAVYYCAISSGWYWFDPWGQGTLVTVSS

SEQ ID NO: 30491 - DNA, 366 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagctatggcatgcactgggtccgccaggctccaggcaaggggctggagtgggtggcaattatatggtatgatggaactaataaatactatgcagactccgtgaagggccgattcaccatctccagagacaattccaagaacacgctgtatctgcaactgaacagcctgagagccgaggacacggctgtgtattactgtgcgcgagatcccttacgtggatacaatgacccggttatggactactggggccagggaaccctggtcaccgtctcctca

SEQ ID NO: 30492 - protein, 122 aa, Artificial Sequence
  Description of Artificial Sequence: Synthetic polypeptide
QVQLVESGGGVVQPGRSLRLSCVASGFTFSSYGMHWVRQAPGKGLEWVAIIWYDGTNKYYADSVKGRFTISRDNSKNTLYLQLNSLRAEDTAVYYCARDPLRGYNDPVMDYWGQGTLVTVSS

SEQ ID NO: 30493 - DNA, 366 bp, Artificial Sequence
  Description of Artificial Sequence: Synthetic polynucleotide
caggtgcagctggtggagtctgggggaggcgtggtccagcctggggggtccctgagactctcctgtgcagcgtctggcttcaccttcagtacctatggcatgcactgggtccgccaggctccaggcaaggggctggagtgggtgacaattatatggtatgatgggactaataaatactatgcagactccgtgaagggccgattcaccatctccagagacaattccaagaacacgctgtatctgcaaatgaacagcctgagagccgaggacacggctgtgtattactgtgcgagagatcccttacgtggatacaatgacccggttatggactactggggccagggaaccctggtcaccgtctcctca

SEQ ID NO: 30494 - protein, 122 aa, Artificial Sequence
  Description of Artificial Sequence: Synthetic polypeptide
QVQLVESGGGVVQPGGSLRLSCAASGFTFSTYGMHWVRQAPGKGLEWVTIIWYDGTNKYYADSVKGRFTISRDNSKNTLYLQMNSLRAEDTAVYYCARDPLRGYNDPVMDYWGQGTLVTVSS

SEQ ID NO: 30495 - DNA, 366 bp, Artificial Sequence
  Description of Artificial Sequence: Synthetic polynucleotide
caggtgcaactggtggagtctgggggaggcgtggtccagcctggggggtccctgagactctcctgtgcagcgtctggcttcaccttcagtacctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaagacacggctgtgtattactgtgcgagagatcccttacgtggatacaatgacccggttatggactactggggccagggaaccctggtcaccgtctcctca

SEQ ID NO: 30496 - protein, 122 aa, Artificial Sequence
  Description of Artificial Sequence: Synthetic polypeptide
QVQLVESGGGVVQPGGSLRLSCAASGFTFSTYGMHWVRQAPGKGLEWVAIIWYDGSNKYYADSVKGRFTISRDNSKNTLYLQMNSLRAEDTAVYYCARDPLRGYNDPVMDYWGQGTLVTVSS

SEQ ID NO: 30497 - DNA, 360 bp, Artificial Sequence
  Description of Artificial Sequence: Synthetic polynucleotide
gaggtgcagctgttggagtctgggggagacttagtacagcctggggggtccctgagactctcctgtgcagcctctggattcacctttagcagctgtgccatgacctgggtccgccaggctccagggaaggggctggagtgggtctcagctattagtggtcgtggtggtaccacgttctacgcagactccgtgaggggccggttcaccatctccagagacaattccaagaacacgctgtttctgcaaatgaacagcctgagagccgaggacacggccgtatattactgtgcgaaagatcttattgggggagctacttactttgactactggggccagggaaccctggtcaccgtctcctca

SEQ ID NO: 30498 - protein, 120 aa, Artificial Sequence
  Description of Artificial Sequence: Synthetic polypeptide
EVQLLESGGDLVQPGGSLRLSCAASGFTFSSCAMTWVRQAPGKGLEWVSAISGRGGTTFYADSVRGRFTISRDNSKNTLFLQMNSLRAEDTAVYYCAKDLIGGATYFDYWGQGTLVTVSS

SEQ ID NO: 30499 - DNA, 363 bp, Artificial Sequence
  Description of Artificial Sequence: Synthetic polynucleotide
caggtgcagctggtggagtctaggggaggcgtggtccagcctgggaggtccctgagactctcctgtgcagcctctggattcaccttcagtagctatggcatgcactgggtccgccaggctccaggcaaggggctggagtgggtggcagttatatcatatgacggaaacaatagacactatgcagactccgtgcagggccgattcaccatttccagagacaattccaagaacacgctgtctctgcaaatgaacagcctgggagctgaggacacggctgtgtattactgtgcgagagatcgtcaccgtttggactactacgctttggacgtctggggccaagggaccacggtcaccgtctcctca

SEQ ID NO: 30500 - protein, 121 aa, Artificial Sequence
  Description of Artificial Sequence: Synthetic polypeptide
QVQLVESRGGVVQPGRSLRLSCAASGFTFSSYGMHWVRQAPGKGLEWVAVISYDGNNRHYADSVQGRFTISRDNSKNTLSLQMNSLGAEDTAVYYCARDRHRLDYYALDVWGQGTTVTVSS

SEQ ID NO: 30501 - DNA, 354 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttaggagctctgccatgagctgggtccgccaggctccagggaaggggctggagtgggtctcagttattagtggtagtggtggtagcacattctacacagactccgtgaagggccggttcaccatctccagagacaattccaagaacacgctgtatctgcaaatgaacagcctgagagccgaggacacggccgtatattactgtgcgaaatcgaatagcagtggctggtttgactactggggccagggaaccctggtcaccgtctcctca

SEQ ID NO: 30502 - protein, 118 aa, Artificial Sequence
  Description of Artificial Sequence: Synthetic polypeptide
EVQLLESGGGLVQPGGSLRLSCAASGFTFRSSAMSWVRQAPGKGLEWVSVISGSGGSTFYTDSVKGRFTISRDNSKNTLYLQMNSLRAEDTAVYYCAKSNSSGWFDYWGQGTLVTVSS

SEQ ID NO: 30503 - DNA, 363 bp, Artificial Sequence
  Description of Artificial Sequence: Synthetic polynucleotide
gaggtgcagttgttggagtctgggggaggcttggcacagcctggggggtccctgagactctcctgtgcagcctctggattcacctttagcagctatgccatgacttgggtccgccaggctccagggaaggggctggagtgggtctcagctattagtggtagtggtggtaacacattcaacgcagactccgtgaagggccggttcaccatctccagagacaattccaagaacacgctgtatctgcaaatgaacagcctgagagccgaggacacggccgtatattactgtgcaaagctggggatcgactactactactacggtatggacgtctggggccaagggaccacggtcaccgtctcctca

SEQ ID NO: 30504 - protein, 121 aa, Artificial Sequence
  Description of Artificial Sequence: Synthetic polypeptide
EVQLLESGGGLAQPGGSLRLSCAASGFTFSSYAMTWVRQAPGKGLEWVSAISGSGGNTFNADSVKGRFTISRDNSKNTLYLQMNSLRAEDTAVYYCAKLGIDYYYYGMDVWGQGTTVTVSS

SEQ ID NO: 30505 - DNA, 342 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtattactgtgcgagagataggggcagctcctggggccagggaatcctggtcaccgtctcctca

SEQ ID NO: 30506 - protein, 114 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARDRGSSWGQGILVTVSS

SEQ ID NO: 30507 - DNA, 366 bp, Artificial Sequence
  Description of Artificial Sequence: Synthetic polynucleotide
caggtgcagctggtggagtctgggggaggcgtggtccagcctgggaggcccctgagactctcctgtgcagcgtctggattcaccttcagtacctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcccttacgtggatacaatgacccggttatggactactggggccagggaaccctggtcaccgtctcctca

SEQ ID NO: 30508 - protein, 122 aa, Artificial Sequence
  Description of Artificial Sequence: Synthetic polypeptide
QVQLVESGGGVVQPGRPLRLSCAASGFTFSTYGMHWVRQAPGKGLEWVAVIWYDGSNKYYADSVKGRFTISRDNSKNTLYLQMNSLRAEDTAVYYCARDPLRGYNDPVMDYWGQGTLVTVSS

SEQ ID NO: 30509 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctagagtgggtggcaattatatggtatgatggaagtaataaatactatgtagactccgtgaagggccgattcaccatctccagagacaattccaagaacacgctgtatctccaaatgaacagcctgagagccgaagacacggctgtgtactattgtgcgagagaggcgtacgatttttggagtggttattgggactactggggccagggaaccctggtcaccgtctcctca

SEQ ID NO: 30510 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAIIWYDGSNKYYVDSVKGRFTISRDNSKNTLYLQMNSLRAEDTAVYYCAREAYDFWSGYWDYWGQGTLVTVSS

SEQ ID NO: 30511 - DNA, 366 bp, Artificial Sequence
  Description of Artificial Sequence: Synthetic polynucleotide
caggtgcagatggtggagtctgggggaggcgtggtccagcctgggaggtccctgagactctcctgtgcagcgtctggattcaccttcagtacctatggcatgcactgggtccgccaggctccaggcaaggggctggaatggatggcaattatatggtatgatggaactaataaatactatgcagactccgtgaagggccgattcaccatctccagagacaattccaagaacacgctgtatctgcaactgaacagcctgagagccgaggacacggctgtgtattactgtgcgcgagatcccttacgtggatacaatgacccggttatggactactggggccagggaaccctggtcaccgtctcctca

SEQ ID NO: 30512 - protein, 122 aa, Artificial Sequence
  Description of Artificial Sequence: Synthetic polypeptide
QVQMVESGGGVVQPGRSLRLSCAASGFTFSTYGMHWVRQAPGKGLEWMAIIWYDGTNKYYADSVKGRFTISRDNSKNTLYLQLNSLRAEDTAVYYCARDPLRGYNDPVMDYWGQGTLVTVSS

SEQ ID NO: 30513 - DNA, 354 bp, Artificial Sequence
  Description of Artificial Sequence: Synthetic polynucleotide
caggtgcagctggtgcagtctggggctgaggtgaagaagcctggggcctcagtgatggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtaccggtttgactactggggccagggaaccctggtcaccgtctcctca

SEQ ID NO: 30514 - protein, 118 aa, Artificial Sequence
  Description of Artificial Sequence: Synthetic polypeptide
QVQLVQSGAEVKKPGASVMVSCKASGYTFTNYDINWVRQATGQGLEWMGWMHPNSGNTGYAQKFQGRVTMTRNTSISTAYMELSSLRSEDTAVYYCAYSSGWYRFDYWGQGTLVTVSS

SEQ ID NO: 30515 - DNA, 363 bp, Artificial Sequence
  Description of Artificial Sequence: Synthetic polynucleotide
gaggtgcagttgttggagtctgggggaggctcggtacagcctggggggtccctgagactctcctgtgcagcctctggattcacctttagcagctatgccatgagctgggtccgccaggctccagggaaggggctggagtgggtctcatttattagtggtagtggtggtaacacattctacgcagactccgtgaagggccggttcaccatctccagagacaattccaagaacacgctgtatctgcaaatgaacagcctgcaagccgaggacacggccgtatattactgtacgaaaagggatacctacaacggttgggatgcttttgatatctggggccaagggacaatggtcaccgtctcttca

SEQ ID NO: 30516 - protein, 121 aa, Artificial Sequence
  Description of Artificial Sequence: Synthetic polypeptide
EVQLLESGGGSVQPGGSLRLSCAASGFTFSSYAMSWVRQAPGKGLEWVSFISGSGGNTFYADSVKGRFTISRDNSKNTLYLQMNSLQAEDTAVYYCTKRDTYNGWDAFDIWGQGTMVTVSS

SEQ ID NO: 30517 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctagagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggcctacgatttttggagtggtttctttgactcctggggccagggaaccctggtcaccgtctcctca

SEQ ID NO: 30518 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCAREAYDFWSGFFDSWGQGTLVTVSS

SEQ ID NO: 30519 - DNA, 363 bp, Artificial Sequence
  Description of Artificial Sequence: Synthetic polynucleotide
caggtgcagctggtggagtcggggggaggcgtggtccagcctgggaggtccctgagactctcctgtgcagcgtctggattcaccttcagtagctatggcatacactgggtccgccaggctccaggcaagggactggagtgggtggcacttatattttatgatggaagtaataaatactatgcagactccgtgaagggccgattcaccatctccagagacaattccaagaacacgctgtatctgcatatgagcagcctgagagccgaggacacggctgtgtattactgtgcgagacggtatagcagcagctggtccggtggtatggacgtctggggccaagggaccacggtcaccgtctcctca

SEQ ID NO: 30520 - protein, 121 aa, Artificial Sequence
  Description of Artificial Sequence: Synthetic polypeptide
QVQLVESGGGVVQPGRSLRLSCAASGFTFSSYGIHWVRQAPGKGLEWVALIFYDGSNKYYADSVKGRFTISRDNSKNTLYLHMSSLRAEDTAVYYCARRYSSSWSGGMDVWGQGTTVTVSS

SEQ ID NO: 30521 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaactaacaaatactatgcagactccgtgaagggccgattcaccatctccagagacaattccaagaacacgctgtatctgcaactgaacagcctgagagccgaggacacggctgtgtattactgtgcgcgagatcccttacgtggatacaatgacccggttatggactactggggccagggaaccctggtcaccgtctcctca

SEQ ID NO: 30522 - protein, 122 aa, Artificial Sequence; identical to SEQ ID NO: 30484
  Description of Artificial Sequence: Synthetic polypeptide

SEQ ID NO: 30523 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcggttagcagtggctggtactggttcgacccctggggccagggaaccctggtcaccgtctcctca

SEQ ID NO: 30524 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAVSSGWYWFDPWGQGTLVTVSS

SEQ ID NO: 30525 - DNA, 354 bp, Artificial Sequence; identical to SEQ ID NO: 30501
  Description of Artificial Sequence: Synthetic polynucleotide

SEQ ID NO: 30526 - protein, 118 aa, Artificial Sequence; identical to SEQ ID NO: 30502
  Description of Artificial Sequence: Synthetic polypeptide

SEQ ID NO: 30527 - DNA, 369 bp, Artificial Sequence; identical to SEQ ID NO: 30471
  Description of Artificial Sequence: Synthetic polynucleotide

SEQ ID NO: 30528 - protein, 123 aa, Artificial Sequence; identical to SEQ ID NO: 30472
  Description of Artificial Sequence: Synthetic polypeptide

SEQ ID NO: 30529 - DNA, 366 bp, Artificial Sequence
  Description of Artificial Sequence: Synthetic polynucleotide
caggtgcaactggtggagtctgggggaggcgtggtccagcctggggggtccctgagactctcctgtgcagcgtctggcttcaccttcagtacctatggcatgcactgggtccgccaggctccaggcaaggggctggagtgggtggcagttatatggtatgatggaagtaataaatactatgcagactccgtgaagggccgattcaccatatccagagacaattccaagaacacgctgtatgtgcaaatgaacagcctgagagccgaggacacggctgtgtattactgtgcgagagatcccttacgtggatacaatgacccggttatggactactggggccagggaaccctggtcaccgtctcctca

SEQ ID NO: 30530 - protein, 122 aa, Artificial Sequence
  Description of Artificial Sequence: Synthetic polypeptide
QVQLVESGGGVVQPGGSLRLSCAASGFTFSTYGMHWVRQAPGKGLEWVAVIWYDGSNKYYADSVKGRFTISRDNSKNTLYVQMNSLRAEDTAVYYCARDPLRGYNDPVMDYWGQGTLVTVSS

SEQ ID NO: 30531 - DNA, 366 bp, Artificial Sequence
  Description of Artificial Sequence: Synthetic polynucleotide
caggtacaggtggtgcagtctggggctgaggtgaagaagcctggggcctcagtgaaggtctcctgcaaggcttctggatacaccttcaccggctactttatgcactgggtgcgacaggcccctggacaagggcttgaatggatgggatggatcaagcctaaaagtggtggcacaaactgtgcacagaggtttcagggcagggtcaccatgaccagggacacgtccatcaccacagcctacatggaactgagcaggctgcgatctgacgacacggccgtgtattattgtgtgagaggggggactacggtgactacgtggggggtctttgactactggggccagggaaccatggtcaccgtctcctca

SEQ ID NO: 30532 - protein, 122 aa, Artificial Sequence
  Description of Artificial Sequence: Synthetic polypeptide
QVQVVQSGAEVKKPGASVKVSCKASGYTFTGYFMHWVRQAPGQGLEWMGWIKPKSGGTNCAQRFQGRVTMTRDTSITTAYMELSRLRSDDTAVYYCVRGGTTVTTWGVFDYWGQGTMVTVSS

SEQ ID NO: 30533 - DNA, 345 bp, Artificial Sequence
  Description of Artificial Sequence: Synthetic polynucleotide
gaggtgcagctgttggagtctgggggaggcttggtgcagcctggggggtccctgagactctcctgtgcagcctctgcattcacctttagcagctatgtcatgagctgggtccgccaggctccagggaaggggctggagtgggtctctgctattagtggtagtggtgatagaacatactacgcagactccgtgaagggccggttcaccatctccagagacgattccaataccacgctgtatctgcaaatgaacagcctgagagccgaggacacggccgtatattactgtgcgagaacagcgggctttgactactggggccagggaaccctggtcaccgtctcctca

SEQ ID NO: 30534 - protein, 115 aa, Artificial Sequence
  Description of Artificial Sequence: Synthetic polypeptide
EVQLLESGGGLVQPGGSLRLSCAASAFTFSSYVMSWVRQAPGKGLEWVSAISGSGDRTYYADSVKGRFTISRDDSNTTLYLQMNSLRAEDTAVYYCARTAGFDYWGQGTLVTVSS

SEQ ID NO: 30535 - DNA, 354 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcgtctattagtggtcgtggtggtagcacgttctacgcagactccgtgaagggccggttcaccgtctccagagacaattccaagaacacgctgtatctgcaaatgaacagcctgagagccgaggacacggccgtatattactgtgcgaaatcgaatagcagtggctggtttgactactggggccagggaaccctggtcaccgtctcctca

SEQ ID NO: 30536 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSSISGRGGSTFYADSVKGRFTVSRDNSKNTLYLQMNSLRAEDTAVYYCAKSNSSGWFDYWGQGTLVTVSS

SEQ ID NO: 30537 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggttacaccttcaccaattatgatctcaactgggtgcgacaggccactggacaagggcttgagtggatgggatggatgcaccctaacagtggtaacacaggctatgcacagaagttccagggcagagtcaccatgaccaggaacacctccataagcacagtttacatggagctgagcagcctgagatctgaggacacggccgtgtattactgtgcgtatagcagtggctggtactactttgactactggggccagggaaccctggtcaccgtctcctca

SEQ ID NO: 30538 - protein, 118 aa, Artificial Sequence
  Description of Artificial Sequence: Synthetic polypeptide
QVQLVQSGAEVKKPGASVKVSCKASGYTFTNYDLNWVRQATGQGLEWMGWMHPNSGNTGYAQKFQGRVTMTRNTSISTVYMELSSLRSEDTAVYYCAYSSGWYYFDYWGQGTLVTVSS

SEQ ID NO: 30539 - DNA, 363 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttagcagctatgccatgagctgggtccgccagactccagggaaggggctggagtgggtctcaattattagtggtagtggtggtaacacatactacgcagactccgtgaagggccggttcaccatctccagagacaattccaagaacacgctgtatctgcaaatgaacagcctgagagccgaggacacggccgtatattactgtgcgaaaagggatacctggaacggttgggatgcttttgatatctggggccaagggacaatggtcaccgtctcttta

SEQ ID NO: 30540 - protein, 121 aa, Artificial Sequence
  Description of Artificial Sequence: Synthetic polypeptide
EVQLLESGGGLVQPGGSLRLSCAASGFTFSSYAMSWVRQTPGKGLEWVSIISGSGGNTYYADSVKGRFTISRDNSKNTLYLQMNSLRAEDTAVYYCAKRDTWNGWDAFDIWGQGTMVTVSL

SEQ ID NO: 30541 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagttataaatactatgcagactccgtgaagggccgattcaccatctccagagacaattccaagaacacgctgtatctgcaaatgagcagcctgagagccgaggacacggctgtgtattactgtgcgagagatgcccacgatttttggagtggttactttgcctactggggccagggagccctggtcaccgtctcctca

SEQ ID NO: 30542 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSYKYYADSVKGRFTISRDNSKNTLYLQMSSLRAEDTAVYYCARDAHDFWSGYFAYWGQGALVTVSS

SEQ ID NO: 30543 - DNA, 369 bp, Artificial Sequence
  Description of Artificial Sequence: Synthetic polynucleotide
gaggtgcaactggtggagtctgggggaggcttggtacagcctggggggtccctgagactctcctgtgcagcctcaggattcaccttcagtggccatagtatgaactgggtccgccaggctccagggaaggggctggagtgggttgcatacattagcattagtggtagtaccataaagtacgcagactctgtgaagggccgattcatcatctccagagacaatgccagggattcactgtatctgcaaatgaacagcctgagagacgaggacacggctgtgtattactgtgcgagaagggggattactgtggttcggaatgaggacggtttggacgtctggggccaagggaccacggtcaccgtctcctca

SEQ ID NO: 30544 - protein, 123 aa, Artificial Sequence
  Description of Artificial Sequence: Synthetic polypeptide
EVQLVESGGGLVQPGGSLRLSCAASGFTFSGHSMNWVRQAPGKGLEWVAYISISGSTIKYADSVKGRFIISRDNARDSLYLQMNSLRDEDTAVYYCARRGITVVRNEDGLDVWGQGTTVTVSS

SEQ ID NO: 30545 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaagggcctggagtgggtgtcaattatatggtatgatggaactaataaatactatgcagactccgtgaagggccgattcaccatctccagagacaattccaagaacacgctgtttctgcaactgaacagcctgagagccgaggacacggctgtctattactgtgcgcgagatcccttacgtggatacaatgacccggttttggactactggggccagggaaccctggtcaccgtctcctca

SEQ ID NO: 30546 - protein, 122 aa, Artificial Sequence
  Description of Artificial Sequence: Synthetic polypeptide
QVQLVESGGGVVQPGRSLRLSCAASGFTFSTYGMHWVRQAPGKGLEWVSIIWYDGTNKYYADSVKGRFTISRDNSKNTLFLQLNSLRAEDTAVYYCARDPLRGYNDPVLDYWGQGTLVTVSS

SEQ ID NO: 30547 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatgcactgggtccgccaggctccaggcaaggggctggagtgggtggcagttatatggtatgatggaagtaataaatactatgccgactccgtgaagggccgattcaccatctccagagacaattccaagaacacgctgtatctgcaaatgaacagcctgagagccgaggacacggctgtatattactgtgcgagagaaaagtatagcagcaactggtacgactacggtatggacgtctggggccaagggaccacggtcaccgtctcctca

SEQ ID NO: 30548 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVAVIWYDGSNKYYADSVKGRFTISRDNSKNTLYLQMNSLRAEDTAVYYCAREKYSSNWYDYGMDVWGQGTTVTVSS

SEQ ID NO: 30549 - DNA, 345 bp, Artificial Sequence
  Description of Artificial Sequence: Synthetic polynucleotide
gaggtgcagttgttggagtctgggggaggcttggtacagcctggggggtccctgagactctcctgtgcagcctctggattcacctttagcagctatgtcatgaactgggtccgccaggctccagggaaggggctggagtgggtctcaggtatgagcggtagtggtggtagaacatactacgcagactccgtgaaggaccggttcaccatctccagagacaattccaagaacacgctgtctctgcaaatgaacagcctgagggccgaggacacggccgtatattactgtgcgagagtgactttctttgactattggggccagggaaccctggtcaccgtctcctca

SEQ ID NO: 30550 - protein, 115 aa, Artificial Sequence
  Description of Artificial Sequence: Synthetic polypeptide
EVQLLESGGGLVQPGGSLRLSCAASGFTFSSYVMNWVRQAPGKGLEWVSGMSGSGGRTYYADSVKDRFTISRDNSKNTLSLQMNSLRAEDTAVYYCARVTFFDYWGQGTLVTVSS

SEQ ID NO: 30551 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgattatgtcatgcactgggtccgccaggctccaggcaaggggctggagtgggtggcagttatatggtatgatggaagtaataaatactatgcagactccgtgaagggccgattcatagtctccagagacaattccaagaacacgctgtatctgcaaatgaacagcctgagagccgaggacacggctgtgtattactgtgcgagagaaaagtatagcagcagctggtacgactacggtttggacgtctggggccaagggaccacggtcaccgtctcctca

SEQ ID NO: 30552 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVAVIWYDGSNKYYADSVKGRFIVSRDNSKNTLYLQMNSLRAEDTAVYYCAREKYSSSWYDYGLDVWGQGTTVTVSS

SEQ ID NO: 30553 - DNA, 369 bp, Artificial Sequence
  Description of Artificial Sequence: Synthetic polynucleotide
gaggtgcagctgttggagtctgggggaggcttggtacagccgggggggtcccggagactctcctgtgaagcctctggattcacctttagcagttatgccatgagctgggtccgccaggctccagggaaggggctggagtgggtctcagttattagtggtagtggtagtaacacatactacgtagactccgtgaagggccggttcaccatctccagagacaattccaagaacacgctgaatctgcaaatgaacagcctgagagccgaggactcggccgtatattactgtacgaaaggttactatgatagtagtggttattactacccttttgacttctggggccagggaaccctggtcaccgtctcctca

SEQ ID NO: 30554 - protein, 123 aa, Artificial Sequence
  Description of Artificial Sequence: Synthetic polypeptide
EVQLLESGGGLVQPGGSRRLSCEASGFTFSSYAMSWVRQAPGKGLEWVSVISGSGSNTYYVDSVKGRFTISRDNSKNTLNLQMNSLRAEDSAVYYCTKGYYDSSGYYYPFDFWGQGTLVTVSS

SEQ ID NO: 30555 - DNA, 363 bp, Artificial Sequence
  Description of Artificial Sequence: Synthetic polynucleotide
caggtgcaactggtggagtctgggggaggcgtggtccagcctgggaggtccctgagactcacctgtgcagcgtctggattcaccttcagtagctatggcatgcactgggtccgccaggctccaggcaaggggctggagtgggtggcaattatatggtatgatggaagttataaatactatacagactccgtgaagggccgattcaccatctccagagacaattccaagaacacgctgtatctgcaaatgaacagcctgagagccgaggacacggctgtgtattactgtgcgagagagacttacgatttttggagtggttattttgtcttctggggccagggaaccctggtcaccgtctcctca

SEQ ID NO: 30556 - protein, 121 aa, Artificial Sequence
  Description of Artificial Sequence: Synthetic polypeptide
QVQLVESGGGVVQPGRSLRLTCAASGFTFSSYGMHWVRQAPGKGLEWVAIIWYDGSYKYYTDSVKGRFTISRDNSKNTLYLQMNSLRAEDTAVYYCARETYDFWSGYFVFWGQGTLVTVSS

SEQ ID NO: 30557 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcgtatagcagtggctggtactactttgacttctggggccagggaaccctggtcaccgtctcctca

SEQ ID NO: 30558 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYYFDFWGQGTLVTVSS

SEQ ID NO: 30559 - DNA, 351 bp, Artificial Sequence
  Description of Artificial Sequence: Synthetic polynucleotide
gaggtgcacctgttggagtctgggggaggcttggtacagactggggggtccctgagactctcctgtgcagcctctggattcacctttagcagctatgccatgacctgggtccgccaggctccagggaaggggctggagtgggtctcagttattagtggtagtggtggtaatacattctacgcagactccgtgaagggccggttcaccatctccagagacaattccaagaatacgctgtatctgcaaatgaacagcctgagagccgaggacacggccgtatattactgtgcgcgccgggacggtgactactttgactactggggccagggaaccctggtcaccgtctcctca

SEQ ID NO: 30560 - protein, 117 aa, Artificial Sequence
  Description of Artificial Sequence: Synthetic polypeptide
EVHLLESGGGLVQTGGSLRLSCAASGFTFSSYAMTWVRQAPGKGLEWVSVISGSGGNTFYADSVKGRFTISRDNSKNTLYLQMNSLRAEDTAVYYCARRDGDYFDYWGQGTLVTVSS

SEQ ID NO: 30561 - DNA, 351 bp, Artificial Sequence
  Description of Artificial Sequence: Synthetic polynucleotide
gaggtgcacctgttggagtctgggggaggcttggtacagactggggggtccctgagactctcctgtgcagcctctggattcacctttagcagctatgccatgacctgggtccgccaggctccagggaaggggctggagtgggtctcagttattagtggtagtggtggtaacacattctacgcagactccgtgaagggccggttcaccatctccagagacaattccaagaacacgctgtatctgcaaatgaacagcctgagagccgaggacacggccgtatattactgtgcgcgccggtacggtgactactttgactactggggccagggaaccctggtcaccgtctcctca

SEQ ID NO: 30562 - protein, 117 aa, Artificial Sequence
  Description of Artificial Sequence: Synthetic polypeptide
EVHLLESGGGLVQTGGSLRLSCAASGFTFSSYAMTWVRQAPGKGLEWVSVISGSGGNTFYADSVKGRFTISRDNSKNTLYLQMNSLRAEDTAVYYCARRYGDYFDYWGQGTLVTVSS

SEQ ID NO: 30563 - DNA, 366 bp, Artificial Sequence
  Description of Artificial Sequence: Synthetic polynucleotide
caggtgcagctggtggagtcggggggaggcgtggtccagcctgggaggtccctgagactctcctgtgtagcgtctggattcacctccagtacctatggcatgcactgggtccgccaggctccaggcaaggggctggaatggatggcaattatatggtatgatggaactaataaatactatgcagactccgtgaagggccgattcaccatctccagagacaattccaagaacacgctgtatctgcaactgaacagcctgagagccgaggacacggctgtgtattactgtgcgcgagatcccttacgtggatacaatgacccggttatggactactggggccagggaaccctggtcaccgtctcctca

SEQ ID NO: 30564 - protein, 122 aa, Artificial Sequence
  Description of Artificial Sequence: Synthetic polypeptide
QVQLVESGGGVVQPGRSLRLSCVASGFTSSTYGMHWVRQAPGKGLEWMAIIWYDGTNKYYADSVKGRFTISRDNSKNTLYLQLNSLRAEDTAVYYCARDPLRGYNDPVMDYWGQGTLVTVSS

SEQ ID NO: 30565 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatggtatgatggaagtaataaatactacgcagactccgtgaagggccgattcaccatctccagagacaatttcaagaacacgctgtatctgcaaatgaacagcctgagagccgaggacacggctgtttattactgtgcgagagaacggtacgatttttggagtggtcattttgactactggggccagggaaccctggtcaccgtctcctca

SEQ ID NO: 30566 - protein, 121 aa, Artificial Sequence
  Description of Artificial Sequence: Synthetic polypeptide
QVQLVESGGGVVQPGRSLRLSCAASGFTFSTYGMHWVRQAPGKGLEWVAVIWYDGSNKYYADSVKGRFTISRDNFKNTLYLQMNSLRAEDTAVYYCARERYDFWSGHFDYWGQGTLVTVSS

SEQ ID NO: 30567 - DNA, 351 bp, Artificial Sequence
  Description of Artificial Sequence: Synthetic polynucleotide
gaggtgcacctgttggagtcggggggaggcttggtacagactggggggtccctgagactctcctgtgcagcctctggattcacctttagcagctatgccatgacctgggtccgccaggctccagggaaggggctggagtgggtctcagttattagtggttttggtggtaacacattctacgcagactccgtgaagggccggttcaccatctccagagacaattccaagaacacgctgtatctgcaaatgaacagcctgagagccgaggacacggccgtatattactgtgcgcgccggtacggtgactactttgactactggggccagggaaccctggtcaccgtctcctca

SEQ ID NO: 30568 - protein, 117 aa, Artificial Sequence
  Description of Artificial Sequence: Synthetic polypeptide
EVHLLESGGGLVQTGGSLRLSCAASGFTFSSYAMTWVRQAPGKGLEWVSVISGFGGNTFYADSVKGRFTISRDNSKNTLYLQMNSLRAEDTAVYYCARRYGDYFDYWGQGTLVTVSS

SEQ ID NO: 30569 - DNA, 363 bp, Artificial Sequence
  Description of Artificial Sequence: Synthetic polynucleotide
caggtgcagctggtggagtcggggggaggcgtggtccagcctgggaggtccctgagactctcctgtgcagcgtctggattcaccttcagtagctatggcatgcactgggtccgccaggctccaggcaaggggctggagtgggtggcacttatattttatgatggaagtaataaatactatgcagactccgtgaagggccgattcaccatctccagagacaattccaagaacacgctgtttctgcaaatgaacagcctgagagccgaggacacggctgtgtattactgtgcgagacggtatagcggcagctggtccggtggtatggacgtctggggccaagggaccacggtcaccgtctcctca

SEQ ID NO: 30570 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVALIFYDGSNKYYADSVKGRFTISRDNSKNTLFLQMNSLRAEDTAVYYCARRYSGSWSGGMDVWGQGTTVTVSS

SEQ ID NO: 30571 - DNA, 354 bp, Artificial Sequence
  Description of Artificial Sequence: Synthetic polynucleotide
gaggtgcagctgttggagtctgggggaggcttggaacagcctggggggtccctgagactctcctgtgcagcctctggattcacctttagcagctttgccatgaactgggtccgccaggctccagggaaggggctggagtgggtctcagttattagcggtcgcggtggtaacacattctacgcagactccgtgaagggccggttcaccatctccagagacaattccaagaacacgctgtttctgcaaatgaacagcctgagagccgaggacacggccgtatatttctgtgcgaaacggactggggatgatgtttttgatgtctggggccaagggacaatggtcaccgtctcttca

SEQ ID NO: 30572 - protein, 118 aa, Artificial Sequence
  Description of Artificial Sequence: Synthetic polypeptide
EVQLLESGGGLEQPGGSLRLSCAASGFTFSSFAMNWVRQAPGKGLEWVSVISGRGGNTFYADSVKGRFTISRDNSKNTLFLQMNSLRAEDTAVYFCAKRTGDDVFDVWGQGTMVTVSS

SEQ ID NO: 30573 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgcctatggcatgcactgggtccgccaggctccaggcaaggggctggagtgggtgacaattatttggtatgatggaagttataaatactatgcagactccgtgaagggccgattcgccatctccagagacaattccaagaatacgctgtatctgcaaatgaacagcctgagagccgaggacacggctgtgtattactgtgcgagaaccggtgtggatccctgggactactacaacggaatggacgtctggggccaagggaccacggtcaccgtctcctca

SEQ ID NO: 30574 - protein, 123 aa, Artificial Sequence
  Description of Artificial Sequence: Synthetic polypeptide
QVQLVESGGGVVQPGRSLRLSCAASGFTFSAYGMHWVRQAPGKGLEWVTIIWYDGSYKYYADSVKGRFAISRDNSKNTLYLQMNSLRAEDTAVYYCARTGVDPWDYYNGMDVWGQGTTVTVSS

SEQ ID NO: 30575 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaagggactggagtgggtggcagttatatggtatgatgaaaataataaacactatgcagactccgcgaagggccgattcaccatctccagagacaattccaagaacacgctgtatctgcaaatgaacagcctgagagtcgaagacacggctgtgtattactgtgcgagagaggttggctggtccgatgactactggggccagggaaccctggtcaccgtctcctca

SEQ ID NO: 30576 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNKHYADSAKGRFTISRDNSKNTLYLQMNSLRVEDTAVYYCAREVGWSDDYWGQGTLVTVSS

SEQ ID NO: 30577 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtgtcagttatatggtatgatggaagtgataaatactatgaagactccgtgaagggccgattcaccatctccagagacaattccaagaacacgctgtatctgcaaatgaacagcctgagagccgaggacacggctgtgtattactgtgcgagagatcatccccggtggagctacggagactactggggccagggaaccctggtcaccgtgtcctca

SEQ ID NO: 30578 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVSVIWYDGSDKYYEDSVKGRFTISRDNSKNTLYLQMNSLRAEDTAVYYCARDHPRWSYGDYWGQGTLVTVSS

SEQ ID NO: 30579 - DNA, 363 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagctatggcatgcactgggtccgccaggctccaggcaaggggctggaatgggtgacaattatatggtatgatggaagttataaatactatgcagactccgtgaagggccgattcaccatctccagagacaattccaagaacacgctgtatctgcaaatgaacagcctgagagccgaggacacggctgtgtattactgtgcgagagatcattacgatttttggagtgggcactttgacttctggggccagggaaccctggtcaccgtctcctca

SEQ ID NO: 30580 - protein, 121 aa, Artificial Sequence
  Description of Artificial Sequence: Synthetic polypeptide
QVQLVESGGGVVQPGRSLRLSCVASGFTFSSYGMHWVRQAPGKGLEWVTIIWYDGSYKYYADSVKGRFTISRDNSKNTLYLQMNSLRAEDTAVYYCARDHYDFWSGHFDFWGQGTLVTVSS

SEQ ID NO: 30581 - DNA, 339 bp, Artificial Sequence
  Description of Artificial Sequence: Synthetic polynucleotide
caggtgcagctggtgcagtctggggctgaagtgaagacgcctggggcctcagtgaaggtctcctgcagggcttctggatacaccttcaccagctacaatatgcactgggtgcgacaggtccctggacaagggcttgagtggatgggatggatcaaccctaacaatggtggctcaaactatacacagaagtttcagggcagggtcaccatgaccagggacacgtccatcagcacagcctacatggagctgagcaggctgagatctgacgacacggccgtgtattactgtgcgagaaagtttggggactggggccagggaaccctggtcaccgtctcctca

SEQ ID NO: 30582 - protein, 113 aa, Artificial Sequence
  Description of Artificial Sequence: Synthetic polypeptide
QVQLVQSGAEVKTPGASVKVSCRASGYTFTSYNMHWVRQVPGQGLEWMGWINPNNGGSNYTQKFQGRVTMTRDTSISTAYMELSRLRSDDTAVYYCARKFGDWGQGTLVTVSS

SEQ ID NO: 30583 - DNA, 366 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagttgggtccgccaggctccagggaaggggctggagtgggtctcagttattagtggtagtggtggtaacacattctacggagactccgtgaagggccggttcaccatctccagagacaattccaagaacacgctgtatctgcaaatgaacagcctgagagccgaggacacggccatatattactgtgcgaaacgggagacctacgactggggatccgatgcttttgatatctggggccaagggacaatggtcaccgtctcttca

SEQ ID NO: 30584 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSVISGSGGNTFYGDSVKGRFTISRDNSKNTLYLQMNSLRAEDTAIYYCAKRETYDWGSDAFDIWGQGTMVTVSS

SEQ ID NO: 30585 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagtagtagtggctggtacatctttgactactggggccagggaaccctggtcaccgtctcctca

SEQ ID NO: 30586 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWYIFDYWGQGTLVTVSS

SEQ ID NO: 30587 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaagggactggagtgggtggcagttatatggtatgatgaaaataataaacactatgcagactccgcgaagggccgattcaccatctccagagacaattccaagaacacgctgtatctgcaaatgaacagcctgagagccgaagacacggctgtgtattactgtgcgagagaggttggctggtccgatgactactggggccagggaaccctggtcatcgtctcctca

SEQ ID NO: 30588 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDENNKHYADSAKGRFTISRDNSKNTLYLQMNSLRAEDTAVYYCAREVGWSDDYWGQGTLVIVSS

SEQ ID NO: 30589 - DNA, 363 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtggatggcaattatatggtatgatggaagttataaatactatgcagactccgtgaagggccgattcaccatctccagagacaattccaagaacacgctgtatctgcaaatgaacagcctgagagccgaggacacggctgtgtattactgtgcgagagatcattacgatttttggagtgggcactttgactactggggccagggaaccctggtcaccgtctcctca

SEQ ID NO: 30590 - protein, 121 aa, Artificial Sequence
  Description of Artificial Sequence: Synthetic polypeptide
QVQLVESGGGVVQPGRSLRLSCAASGFTFSSYGMHWVRQAPGKGLEWMAIIWYDGSYKYYADSVKGRFTISRDNSKNTLYLQMNSLRAEDTAVYYCARDHYDFWSGHFDYWGQGTLVTVSS

SEQ ID NO: 30591 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagttgggtccgccaggctccagggaaggggctggagtgggtctcagttattagtggtagaggtggtaccacattctacgcagactccgtgaagggccggttcaccatctccagagacaattccaagaacacgctgtatctgcaaatgaacagcctgagagccgaggacacggccgtatattactgtgcgaaacggactggggatgatgtttttgatatctggggccaagggacaatggtcaccgtctcttca

SEQ ID NO: 30592 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSVISGRGGTTFYADSVKGRFTISRDNSKNTLYLQMNSLRAEDTAVYYCAKRTGDDVFDIWGQGTMVTVSS

SEQ ID NO: 30593 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcaattatatcatatgctggaagtactaaattctatgcagactccgtgaagggccgattcaccatctccagagacaattccaagaacacgctgtatctgcaaatgaacagcctgagagctgaggacacggctgtgtattactgtgtgagaaggcccccgcagtggctggtagagggctacggtatggacgtctggggccaagggaccacggtcaccgtctcctca

SEQ ID NO: 30594 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAIISYAGSTKFYADSVKGRFTISRDNSKNTLYLQMNSLRAEDTAVYYCVRRPPQWLVEGYGMDVWGQGTTVTVSS

SEQ ID NO: 30595 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatctgctggaagtaataaatactatgcagactccgtgaagggccgattcaccatctccagagacaattccaagaacacgctgtatctgcaaatgaacagcctgagagctgaggacacggctgtgtattattgtgcgagaaggtatagcagtggctgggactggttcgacccctggggccagggaaccctggtcaccgtctcctca

SEQ ID NO: 30596 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVISSAGSNKYYADSVKGRFTISRDNSKNTLYLQMNSLRAEDTAVYYCARRYSSGWDWFDPWGQGTLVTVSS

SEQ ID NO: 30597 - DNA, 348 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagggactatagcatgaactgggtccgccaggctccagggaaggggctggagtgggtctcatctattagtagtggtagtggttacatacactacgcagactcagtgaagggccgattcaccatctccagagacaacgccaagaactcactgtatctgcaaatgaacagcctgagagccgaggacacggctgtgtattactgtgcgcgagcaactatggcccttgactactggggccagggaaccctggtcaccgtctcctca

SEQ ID NO: 30598 - protein, 116 aa, Artificial Sequence
  Description of Artificial Sequence: Synthetic polypeptide
EVQLVESGGGLVKPGGSLRLSCAASGFTFRDYSMNWVRQAPGKGLEWVSSISSGSGYIHYADSVKGRFTISRDNAKNSLYLQMNSLRAEDTAVYYCARATMALDYWGQGTLVTVSS

SEQ ID NO: 30599 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcaataattactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgcattactgtgcgagagatcggggatactatggctactacggtatggacgtctggggccaagggaccacggtcaccgtctcctca

SEQ ID NO: 30600 - protein, 120 aa, Artificial Sequence
  Description of Artificial Sequence: Synthetic polypeptide
QVQLQESGPGLVKPSETLSLTCTVSGGSINNYYWSWIRQPAGKGLEWIGRIYTSGSTNYNPSLKSRVTMSVDTSKNQFSLKLSSVTAADTAVHYCARDRGYYGYYGMDVWGQGTTVTVSS

SEQ ID NO: 30601 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatcagggcgtgggctacgacggtttggacgtctggggccaagggaccacggtcaccgtctcctca

SEQ ID NO: 30602 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDQGVGYDGLDVWGQGTTVTVSS

SEQ ID NO: 30603 - DNA, 360 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtaactatggcatgcactgggtccgccaggctccaggcaaggggctggagtgggtggcaattatatggtttgatggaagtaataaatactatgcagactccgtgaagggccgattcaccatctccagagacaattccaataacacgctgtatctgcaaatgaacagcctgcgagccgaggacacggctgtgtattactgtgcgaaagcccagggggtctactactacgttatggacgtctggggccaagggaccacggtcaccgtctcctca

SEQ ID NO: 30604 - protein, 120 aa, Artificial Sequence
  Description of Artificial Sequence: Synthetic polypeptide
QVQLVESGGGVVQPGRSLRLSCTASGFTFSNYGMHWVRQAPGKGLEWVAIIWFDGSNKYYADSVKGRFTISRDNSNNTLYLQMNSLRAEDTAVYYCAKAQGVYYYVMDVWGQGTTVTVSS

SEQ ID NO: 30605 - DNA, 369 bp, Artificial Sequence
  Description of Artificial Sequence: Synthetic polynucleotide
gaggtgcagctgttggactctgggggaggcttgggacagcctggggggtccctgagactctcctgtgcagcctctggattcacctttgacagctatgccatgaactgggtccgccaggctccagggaaggggctggagtgggtctcaactattagtggtactggtcgtaggacatactacgcagactccgtgaagggccggttcaccatctccagagacaattccaagaacacgctgtatctgcaaatgaatagcctgagagccgaggacacggccgtatattactgtgcgaaagaggaggattactatgatagtagtggcccggggttcgacccctggggccagggaaccctggtcaccgtctcctca

SEQ ID NO: 30606 - protein, 123 aa, Artificial Sequence
  Description of Artificial Sequence: Synthetic polypeptide
EVQLLDSGGGLGQPGGSLRLSCAASGFTFDSYAMNWVRQAPGKGLEWVSTISGTGRRTYYADSVKGRFTISRDNSKNTLYLQMNSLRAEDTAVYYCAKEEDYYDSSGPGFDPWGQGTLVTVSS

SEQ ID NO: 30607 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtatttatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatcagggcgtgggctacgacggtttggacgtctggggccaagggaccacggtcaccgtctcctca

SEQ ID NO: 30608 - protein, 120 aa, Artificial Sequence
  Description of Artificial Sequence: Synthetic polypeptide
QVQLVESGGGVVQPGRSLRLSCAASGFTFSIYGMHWVRQAPGKGLEWVAVIWYDGSNKNYADSVKGRFTISRDNSKNTLYLQMNSLRAEDTAVYYCARDQGVGYDGLDVWGQGTTVTVSS

SEQ ID NO: 30609 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagaagctaccactggagctggatccggcagcccgccgggaagggactggagtggattgggcttatctataccagtaggagcaccatttacaacccctccctcaagagtcgagtcaccctgtcagtagacacgtccaagaaccagttctccctgaagctgagctctgtgaccgccgcggacacggccgtgtattactgtgcgagactccggtataactggaacttcccttactttgactactggggccagggaaccctggtcaccgtctcctca

SEQ ID NO: 30610 - protein, 120 aa, Artificial Sequence
  Description of Artificial Sequence: Synthetic polypeptide
QLQLQESGPGLVKPSETLSLTCTVSGGSIRSYHWSWIRQPAGKGLEWIGLIYTSRSTIYNPSLKSRVTLSVDTSKNQFSLKLSSVTAADTAVYYCARLRYNWNFPYFDYWGQGTLVTVSS

SEQ ID NO: 30611 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggaactggatccgccagcacccagggaagggcctggagtggattgggtatatctattacagtgggagcacctactacaacccgtccctcaagagtcgagttaccatatcagtagacacgtctaagaaccagttttttctgaagctgaactctgtgactgccgcggacacggccgtgtattactgtgcgagatccgggtataattgggacgccggggtcgacccctggggccggggaaccctggtcaccgtctcctca

SEQ ID NO: 30612 - protein, 121 aa, Artificial Sequence
  Description of Artificial Sequence: Synthetic polypeptide
QVQLQESGPGLVKPSQTLSLTCTVSGGSISSGGYYWNWIRQHPGKGLEWIGYIYYSGSTYYNPSLKSRVTISVDTSKNQFFLKLNSVTAADTAVYYCARSGYNWDAGVDPWGRGTLVTVSS

SEQ ID NO: 30613 - DNA, 360 bp, Artificial Sequence
  Description of Artificial Sequence: Synthetic polynucleotide
caggtgcagctggtggagtctgggggagccgtggtccagcctgggaggtccctgagactctcctgtgcagcctctggattcaccttcagtagctatggcatgcactgggtccgccaggctccaggcaaggggctggagtgggtggcagttatatcatatgatggaggttataaaaactatgtagactccgtgaagggccgattcaccatctccagagacaattccaagaacacgctgtatctgcaaatgaatagcctgagagctgaggacacggctgtgtattactgtgcgagaggtacccacgggtactactacggtgtggacgtctggggccaagggaccacggtcaccgtctcctca

SEQ ID NO: 30614 - protein, 120 aa, Artificial Sequence
  Description of Artificial Sequence: Synthetic polypeptide
QVQLVESGGAVVQPGRSLRLSCAASGFTFSSYGMHWVRQAPGKGLEWVAVISYDGGYKNYVDSVKGRFTISRDNSKNTLYLQMNSLRAEDTAVYYCARGTHGYYYGVDVWGQGTTVTVSS

SEQ ID NO: 30615 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggactcagctattattggtaatggtggtaggacatactacgcagactccgtgaagggccggttcaccatctccagagacaattccaagaacacgctgtatctgcaaatgaacagcctgagagccgaggacacggccgtatattactgtgcgaaagatatgggtagatacagctatggtttctttgactactggggccagggaaccctggtcaccgtctcctca

SEQ ID NO: 30616 - protein, 121 aa, Artificial Sequence
  Description of Artificial Sequence: Synthetic polypeptide
EVQLLESGGGLVQPGGSLRLSCAASGFTFSSYAMSWVRQAPGKGLEWDSAIIGNGGRTYYADSVKGRFTISRDNSKNTLYLQMNSLRAEDTAVYYCAKDMGRYSYGFFDYWGQGTLVTVSS

SEQ ID NO: 30617 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaggaactatggcatgcactgggtccgccaggctccaggcaaggggctggagtgggtggcagttatatggtttgatggaagtaatgactactatgcagactccgtgaagggccgattcaccatctccagagacaattccaagaacacgctgtcactgcaaatgaacagcctgagagccgaggacacggctgtgtattactgtgcgagagatagaagcgtcggctacgacggtttagatgtctggggccaagggaccacggtcaccgtctcctca

SEQ ID NO: 30618 - protein, 120 aa, Artificial Sequence
  Description of Artificial Sequence: Synthetic polypeptide
QVQLVESGGGVVQPGRSLRLSCAASGFTFRNYGMHWVRQAPGKGLEWVAVIWFDGSNDYYADSVKGRFTISRDNSKNTLSLQMNSLRAEDTAVYYCARDRSVGYDGLDVWGQGTTVTVSS

SEQ ID NO: 30619 - DNA, 360 bp, Artificial Sequence
  Description of Artificial Sequence: Synthetic polynucleotide
caggtgcagctggtggaatctgggggaggcgtggtccagcctgggaggtccctgaaactctcctgtgcagcgtctggattcaccttcagtacctatggcatgcactgggtccgccaggctccaggcaagggactggagtgggtggcagttatatggtatgatggaactaataaaaactatgcagactccgtgaagggccgattcaccatctccagagacaattccaagaacacgctgtgtctgcaaatgaacagcctgagagccgaggacacggctgtgtattactgtgcgagagatcagggcgtgggctacgacggtttggacgtctggggccaagggaccacggtcaccgtctcctca

SEQ ID NO: 30620 - protein, 120 aa, Artificial Sequence
  Description of Artificial Sequence: Synthetic polypeptide
QVQLVESGGGVVQPGRSLKLSCAASGFTFSTYGMHWVRQAPGKGLEWVAVIWYDGTNKNYADSVKGRFTISRDNSKNTLCLQMNSLRAEDTAVYYCARDQGVGYDGLDVWGQGTTVTVSS

SEQ ID NO: 30621 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttatcactggagctggatccggcagcccgccgggaagggactggagtggattggccatatctataccagtgggagcaccaagtacaacccctccctcaagagtcgagtcaccatgtcagtagacacgtccaagaaccagttctccctgaagctgagctctgtgaccgccgcggacacggccgtgtattactgtgcgagactccggtataactggaacttccctttctttgactattggggccagggaaccctggtcaccgtctcctca

SEQ ID NO: 30622 - protein, 120 aa, Artificial Sequence
  Description of Artificial Sequence: Synthetic polypeptide
QVQLQESGPGLVKPSETLSLTCTVSGGSISSYHWSWIRQPAGKGLEWIGHIYTSGSTKYNPSLKSRVTMSVDTSKNQFSLKLSSVTAADTAVYYCARLRYNWNFPFFDYWGQGTLVTVSS

SEQ ID NO: 30623 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcccatagcagtggctggtactactttgactactggggccagggaaccctggtcaccgtctcctca

SEQ ID NO: 30624 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAHSSGWYYFDYWGQGTLVTVSS

SEQ ID NO: 30625 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtttctggtggctccatcaacagtggtggttactactggaactggatccgccagcacccagggaagggcctggagtggattgggtacatcttttacagtgggagcacctactacaacccgtccctcaagagtcgagtcaccatatcagtagacacgtctaagaaccagttctccctgaagctgagctctgtgactgccgcggacacggccgtgtattactgtgcgagaggggattacgatggttcggggagttatcactactattacggtatggacgtctggggccaagggaccacggtcaccgtctcctca

SEQ ID NO: 30626 - protein, 127 aa, Artificial Sequence
  Description of Artificial Sequence: Synthetic polypeptide
QVQLQESGPGLVKPSQTLSLTCTVSGGSINSGGYYWNWIRQHPGKGLEWIGYIFYSGSTYYNPSLKSRVTISVDTSKNQFSLKLSSVTAADTAVYYCARGDYDGSGSYHYYYGMDVWGQGTTVTVSS

SEQ ID NO: 30627 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatgaacactatgcagactccgtgaagggccgattcaccatctccagagacaattccaagaacacgctgtatctgcaaatgaacagcctgagagccgaggacacggctgtgtattactgtgcgagagataggggggtgggttactacggtttggacgtctggggccaagggaccacggtcaccgtctcctca

SEQ ID NO: 30628 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNEHYADSVKGRFTISRDNSKNTLYLQMNSLRAEDTAVYYCARDRGVGYYGLDVWGQGTTVTVSS

SEQ ID NO: 30629 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagcacccagggaagggcctggagtggattgggtacatcttttacagtgggagcacctactacaacccgtccctcaagagtcgagttaccatatcagtagacacgtctaagaaccagttctccctgaagctgagctctgtgactgccgcggacacggccgtgtattactgtgcgagaggggattacgatggttcggggagttatcactactactacggtatggacgtctggggccaagggaccacggtcaccgtctcctca

SEQ ID NO: 30630 - protein, 127 aa, Artificial Sequence
  Description of Artificial Sequence: Synthetic polypeptide
QVQLQESGPGLVKPSQTLSLTCTVSGGSISSGDYYWNWIRQHPGKGLEWIGYIFYSGSTYYNPSLKSRVTISVDTSKNQFSLKLSSVTAADTAVYYCARGDYDGSGSYHYYYGMDVWGQGTTVTVSS

SEQ ID NO: 30631 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagctcccagggaagggcctggagtggattgggtacatcttttacagtgggagcacctactacaacccgtccctcaagagtcgacttaccatatcagtggacacgtctaagaaccagttctccctgaaactgaactctgtgactgccgcggacacggccgtgtattactgtgcgagaggggattacgatggttcggggagttatcacttctactacggtatggacgtctggggccaagggaccacggtcaccgtctcctca

SEQ ID NO: 30632 - protein, 127 aa, Artificial Sequence
  Description of Artificial Sequence: Synthetic polypeptide
QVQLQESGPGLVKPSQTLSLTCTVSGGSISSGDYYWNWIRQLPGKGLEWIGYIFYSGSTYYNPSLKSRLTISVDTSKNQFSLKLNSVTAADTAVYYCARGDYDGSGSYHFYYGMDVWGQGTTVTVSS

SEQ ID NO: 30633 - DNA, 381 bp, Artificial Sequence
  Description of Artificial Sequence: Synthetic polynucleotide
caggtgcaactgaaggagtcgggcccaggactggtgaagccttcacagaccctgtccctcacctgcactgtctctggtggctccatcaacagtggtgattactactggaactggatccgccagcacccagggaagggcctggactggattgggtacatcttttacagtgggagcacctactacaacccgtccctcaagagtcgagttaccatatcagtagacacgtctaagaaccagttctccctgaagctgagctctgtgactgccgcggacacggccgtgtattactgtgcgagaggggattacgatggttcggggagttatcactactattacggtatggacgtctggggccaagggaccacggtcaccgtctcctca

SEQ ID NO: 30634 - protein, 127 aa, Artificial Sequence
  Description of Artificial Sequence: Synthetic polypeptide
QVQLKESGPGLVKPSQTLSLTCTVSGGSINSGDYYWNWIRQHPGKGLDWIGYIFYSGSTYYNPSLKSRVTISVDTSKNQFSLKLSSVTAADTAVYYCARGDYDGSGSYHYYYGMDVWGQGTTVTVSS

SEQ ID NO: 30635 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagaagctaccactggagctggatccggcagcccgccgggaagggactggagtggattggacttatctataccagtaggagcaccaattacaacccctccctcaagagtcgagtcaccatgtcagttgacacgtccaagaaccagttctccctgaagctgaactctgtgaccgccgcggacacggccgtgtattactgtgcgagactccggtataactggaacttcccttactttgactactggggccagggaaccctggtcaccgtctcctca

SEQ ID NO: 30636 - protein, 120 aa, Artificial Sequence
  Description of Artificial Sequence: Synthetic polypeptide
QLQLQESGPGLVKPSETLSLTCTVSGGSIRSYHWSWIRQPAGKGLEWIGLIYTSRSTNYNPSLKSRVTMSVDTSKNQFSLKLNSVTAADTAVYYCARLRYNWNFPYFDYWGQGTLVTVSS

SEQ ID NO: 30637 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggacggatgaaccctaacagtggtaacacaggctatgcacagaagttccagggcagagtcaccatgaccaggaacacctccataagcacagcctacatggagctgagcagcctgagatctgaggacacggccgtgtattactgtgcccatagcagtggctggtacatctttgactactggggccagggaaccctggtcaccgtctcctca

SEQ ID NO: 30638 - protein, 118 aa, Artificial Sequence
  Description of Artificial Sequence: Synthetic polypeptide
QVQLVQSGAEVKKPGASVKVSCKASGYTFTNYDINWVRQATGQGLEWMGRMNPNSGNTGYAQKFQGRVTMTRNTSISTAYMELSSLRSEDTAVYYCAHSSGWYIFDYWGQGTLVTVSS

SEQ ID NO: 30639 - DNA, 360 bp, Artificial Sequence; identical to SEQ ID NO: 28165
  Description of Artificial Sequence: Synthetic polynucleotide

SEQ ID NO: 30640 - protein, 120 aa, Artificial Sequence; identical to SEQ ID NO: 28166
  Description of Artificial Sequence: Synthetic polypeptide

SEQ ID NO: 30641 - DNA, 360 bp, Artificial Sequence; identical to SEQ ID NO: 30601
  Description of Artificial Sequence: Synthetic polynucleotide

SEQ ID NO: 30642 - protein, 120 aa, Artificial Sequence; identical to SEQ ID NO: 30602
  Description of Artificial Sequence: Synthetic polypeptide

SEQ ID NO: 30643 - DNA, 360 bp, Artificial Sequence
  Description of Artificial Sequence: Synthetic polynucleotide
caggtgcagttggtggagtctgggggaggcgtgggccagcctgggaggtccctgagactctcctgtgcagcgtctggattcaccttcagtagttatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatttctctgtagggtacgacggtatggacgtctggggccaagggaccacggtcaccgtctcctca

SEQ ID NO: 30644 - protein, 120 aa, Artificial Sequence
  Description of Artificial Sequence: Synthetic polypeptide
QVQLVESGGGVGQPGRSLRLSCAASGFTFSSYGMHWVRQAPGKGLEWVAVIWYDGSNKNYADSVKGRFTISRDNSKNTLYLQMNSLRAEDTAVYYCARDFSVGYDGMDVWGQGTTVTVSS

SEQ ID NO: 30645 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggaactggatccgccagcacccagggaagggcctggagtggattgggtacatcttttacagtgggagcacctactacaacccgtccctcaggagtcgacttaccatatcaatagacacgtctaagaaccagttctccctgaagctgacctctgtgactgccgcggacacggccgtatattactgtgggagatccgggtataactgggacaacggggtcgacccctggggccagggaaccctggtcaccgtctcctca

SEQ ID NO: 30646 - protein, 121 aa, Artificial Sequence
  Description of Artificial Sequence: Synthetic polypeptide
QVQLQESGPGLVKPSQTLSLTCTVSGGSISSGGYYWNWIRQHPGKGLEWIGYIFYSGSTYYNPSLRSRLTISIDTSKNQFSLKLTSVTAADTAVYYCGRSGYNWDNGVDPWGQGTLVTVSS

SEQ ID NO: 30647 - DNA, 348 bp, Artificial Sequence
  Description of Artificial Sequence: Synthetic polynucleotide
gagatacaggtggtggagtctgggggaggcctggtcaagcctggggggtccctgagactctcctgtgcagcctctggattcaccttcagagactatagcatgaactgggtccgccaggctccagggaaggggctggagtgggtctcatccattagtagtggtagtggttacatatattatgcagactcagtgaagggccgattcaccatctccagagacaacgccaagaactcactgtatctgcaaatgaacagcctgagagccgaggacacggctgtgtattactgtgcgagagctactatggcccttgactactggggccagggagccctggtcaccgtctcctca

SEQ ID NO: 30648 - protein, 116 aa, Artificial Sequence
  Description of Artificial Sequence: Synthetic polypeptide
EIQVVESGGGLVKPGGSLRLSCAASGFTFRDYSMNWVRQAPGKGLEWVSSISSGSGYIYYADSVKGRFTISRDNAKNSLYLQMNSLRAEDTAVYYCARATMALDYWGQGALVTVSS

SEQ ID NO: 30649 - DNA, 369 bp, Artificial Sequence; identical to SEQ ID NO: 30605
  Description of Artificial Sequence: Synthetic polynucleotide

SEQ ID NO: 30650 - protein, 123 aa, Artificial Sequence; identical to SEQ ID NO: 30606
  Description of Artificial Sequence: Synthetic polypeptide

SEQ ID NO: 30651 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcaacgtctggattcaccttcagtagctatggcatgcactgggtccgccaggctccaggcaaggggctggagtgggtggcagttatatggtatgatggaagtaataaacattatgcagactccgtgaagggccgattcaccatctccagagacaattccaagaacacactatatctgcaaatgaacagcctgagagccgaggacacggctgtttattactgtgcgagagatagaacagtgggatactccggtatggacgtctggggccaagggaccacggtcaccgtctcctca

SEQ ID NO: 30652 - protein, 120 aa, Artificial Sequence
  Description of Artificial Sequence: Synthetic polypeptide
QVQLVESGGGVVQPGRSLRLSCATSGFTFSSYGMHWVRQAPGKGLEWVAVIWYDGSNKHYADSVKGRFTISRDNSKNTLYLQMNSLRAEDTAVYYCARDRTVGYSGMDVWGQGTTVTVSS

SEQ ID NO: 30653 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagaagctaccactggagctggatccggcagcccgccgggaagggactggagtggattgggcttatctataccagtaggagcaccaattacaacccctccctcaagagtcgagtcaccatgtcagtagacacgtccaagaaccagttctccctgaagctgagctctgtgaccgccgcggacacggccgtgtattactgtgcgagactccggtataactggaacttcccttactttgacttctggggccagggaaccctggtcaccgtctcctca

SEQ ID NO: 30654 - protein, 120 aa, Artificial Sequence
  Description of Artificial Sequence: Synthetic polypeptide
QLQLQESGPGLVKPSETLSLTCTVSGGSIRSYHWSWIRQPAGKGLEWIGLIYTSRSTNYNPSLKSRVTMSVDTSKNQFSLKLSSVTAADTAVYYCARLRYNWNFPYFDFWGQGTLVTVSS

SEQ ID NO: 30655 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactacgcagactccgtgaagggccgattcaccatctccagagacaattccaagaacacgctgtatctgcaaatgaacagcctgagagccgaggacacggctatgtattactgtgcgagagatcagggcgtgggctacgacggtttggacgtctggggccaagggacctcggtcaccgtctcctca

SEQ ID NO: 30656 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAMYYCARDQGVGYDGLDVWGQGTSVTVSS

SEQ ID NO: 30657 - DNA, 360 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcacctatgccatgagttgggtccgccaggctccagggaaggggctggagtgggtctcagctattagtcgtagtggtggtaacacacactacgcagactccgtgaagggccggttcaccatctccagagacaattccaagaatacgctgtatctgcaaatgaacagcctgagagccgaggacacggccgtatattcctgtgcgaaagatggattcggtgggagctcctactttgactactggggccagggaaccctggtcaccgtctcctca

SEQ ID NO: 30658 - protein, 120 aa, Artificial Sequence
  Description of Artificial Sequence: Synthetic polypeptide
EVQLLESGGGLVQPGGSLRLSCAASGFTFSTYAMSWVRQAPGKGLEWVSAISRSGGNTHYADSVKGRFTISRDNSKNTLYLQMNSLRAEDTAVYSCAKDGFGGSSYFDYWGQGTLVTVSS

SEQ ID NO: 30659 - DNA, 339 bp, Artificial Sequence; identical to SEQ ID NO: 30581
  Description of Artificial Sequence: Synthetic polynucleotide

SEQ ID NO: 30660 - protein, 113 aa, Artificial Sequence; identical to SEQ ID NO: 30582
  Description of Artificial Sequence: Synthetic polypeptide

SEQ ID NO: 30661 - DNA, 351 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtgactatggcatgcactgggtccgccaggctccaggcaaggggctggagtgggtggcagttatttggtatgatgaaactaataaacactatggagactccgtgaagggccgattcaccatctccagagacaattccaaggacacgctgtatctgcaaatgaacagcctgagagccgaggacacggctgtgtattactgtgcgagagaggttggctggcacgatgactattggggccagggaaccctggtcaccgtctcctca

SEQ ID NO: 30662 - protein, 117 aa, Artificial Sequence
  Description of Artificial Sequence: Synthetic polypeptide
QVQLVESGGGVVQPGRSLRLSCVASGFTFSDYGMHWVRQAPGKGLEWVAVIWYDETNKHYGDSVKGRFTISRDNSKDTLYLQMNSLRAEDTAVYYCAREVGWHDDYWGQGTLVTVSS

SEQ ID NO: 30663 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatttggtatgatgaaactaataaacactatggagactccgtgaagggccgattcaccatctccagagacaattccaaggacacgctgtatctgcaaatgaacagcctgagagccgaggacacggctgtgtattactgtgcgagagaggttggctggcacgatgactattggggccagggaaccctggtcaccgtctcctca

SEQ ID NO: 30664 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDETNKHYGDSVKGRFTISRDNSKDTLYLQMNSLRAEDTAVYYCAREVGWHDDYWGQGTLVTVSS

SEQ ID NO: 30665 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcaatagctatagcatgaactgggtccgccaggctccagggaaggggctggagtgggtctcatccattagcagtagtggtagttacatatattacgcagactcagtgaagggccgattcaccatctccagagacaacgccaagaactcactgtatctgcaaatgcacagcctgagagccgaggacacggctgtgtattactgtgcgagaagcaacctttttgactgctggggccagggaaccccggtcaccgtctcctca

SEQ ID NO: 30666 - protein, 115 aa, Artificial Sequence
  Description of Artificial Sequence: Synthetic polypeptide
EVQLVESGGGLVKPGGSLRLSCAASGFTFNSYSMNWVRQAPGKGLEWVSSISSSGSYIYYADSVKGRFTISRDNAKNSLYLQMHSLRAEDTAVYYCARSNLFDCWGQGTPVTVSS

SEQ ID NO: 30667 - DNA, 339 bp, Artificial Sequence; identical to SEQ ID NO: 30581
  Description of Artificial Sequence: Synthetic polynucleotide

SEQ ID NO: 30668 - protein, 113 aa, Artificial Sequence; identical to SEQ ID NO: 30582
  Description of Artificial Sequence: Synthetic polypeptide

SEQ ID NO: 30669 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcaattatatggtatgatggaagttataaatattatgcagactccgtgaagggccgattcaccatctccagagacaattccaagaacacgctgtatctgcaaatgaacagcctgagagccgaggacacggctgtgtattactgtgcgagagatcattacgatttttggagtgggcactttgactactggggccagggaaccctggtcaccgtctcctca

SEQ ID NO: 30670 - protein, 121 aa, Artificial Sequence
  Description of Artificial Sequence: Synthetic polypeptide
QVQLVESGGGVVQPGRSLRLSCAASGFTFSTYGMHWVRQAPGKGLEWVAIIWYDGSYKYYADSVKGRFTISRDNSKNTLYLQMNSLRAEDTAVYYCARDHYDFWSGHFDYWGQGTLVTVSS

SEQ ID NO: 30671 - DNA, 354 bp, Artificial Sequence; identical to SEQ ID NO: 30591
  Description of Artificial Sequence: Synthetic polynucleotide

SEQ ID NO: 30672 - protein, 118 aa, Artificial Sequence; identical to SEQ ID NO: 30592
  Description of Artificial Sequence: Synthetic polypeptide

SEQ ID NO: 30673 - DNA, 339 bp, Artificial Sequence
  Description of Artificial Sequence: Synthetic polynucleotide
caggtgcagctggtgcagtctggggctgaggtgaagacgcctggggcctcagtgaaggtctcctgcagggcttctggatacaccttcaccagctacaatatgcactgggtacgacaggtccctggacaagggcttgagtggatgggatggatcaaccctaacagtggtggctcaaactatacacagaagtttcagggcaggatcaccatgaccagggacacgtccatcagcacagcctacatggagctgagcaggctgagatctgacgacacggccgtatattactgtgcgagaaagtttggggactggggccagggaaccctggtcaccgtctcctca

SEQ ID NO: 30674 - protein, 113 aa, Artificial Sequence
  Description of Artificial Sequence: Synthetic polypeptide
QVQLVQSGAEVKTPGASVKVSCRASGYTFTSYNMHWVRQVPGQGLEWMGWINPNSGGSNYTQKFQGRITMTRDTSISTAYMELSRLRSDDTAVYYCARKFGDWGQGTLVTVSS

SEQ ID NO: 30675 - DNA, 354 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctctgccatgaactgggtccgccaggctccagggaaggggctggagtgggtctcagttattagtggtagtggtggttacacatactacgcagactccgtgaagggccggttcaccatctccagagacaattccaagaacacgctgtatctgcaaatgaacagcctgagagccgaggacacggccgtatatttctgtgcgaaaaggaacaccgatgatgcttttgatatctggggccaagggacaatggtcaccgtctcttca

SEQ ID NO: 30676 - protein, 118 aa, Artificial Sequence
  Description of Artificial Sequence: Synthetic polypeptide
EVQLLESGGGLVQPGGSLRLSCAASGFTFSSSAMNWVRQAPGKGLEWVSVISGSGGYTYYADSVKGRFTISRDNSKNTLYLQMNSLRAEDTAVYFCAKRNTDDAFDIWGQGTMVTVSS

SEQ ID NO: 30677 - DNA, 339 bp, Artificial Sequence
  Description of Artificial Sequence: Synthetic polynucleotide
caggtgcagctggtgcagtctggggctgaggtgaagacgcctggggcctcagtgaaggtctcctgcagggcttctggatacaccttcaccagctacaatatgcactgggtgcgacaggtccctggacaagggcttgagtggatgggatggatcaaccctaacagtggtggctcaaactatacacagaagtttcagggcagggtcaccatgaccagggacacgtccatcagcacagcctacatggagctgagcaggctgagatctgacgacacggccgtgtattactgtgcgagaaagtttggggactggggccagggaaccctggtcaccgtctcctca

SEQ ID NO: 30678 - protein, 113 aa, Artificial Sequence
  Description of Artificial Sequence: Synthetic polypeptide
QVQLVQSGAEVKTPGASVKVSCRASGYTFTSYNMHWVRQVPGQGLEWMGWINPNSGGSNYTQKFQGRVTMTRDTSISTAYMELSRLRSDDTAVYYCARKFGDWGQGTLVTVSS

SEQ ID NO: 30679 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtgacaattatatggtatgatggaagttataaatactatgcagactccgtgaagggccgattcaccatctccagagacaattccaagaacacgctgtttctgcaaatgaacagcctgagagccgaagacacggctgtgtattactgtgcgagagagagatacgatttttggagtggtcattttgactactggggccagggaaccctggtcaccgtctcctca

SEQ ID NO: 30680 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVTIIWYDGSYKYYADSVKGRFTISRDNSKNTLFLQMNSLRAEDTAVYYCARERYDFWSGHFDYWGQGTLVTVSS

SEQ ID NO: 30681 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtatgatggaagttataaatactatgcagactccgtgaagggccgattcaccatctccagagacaattccaagaacacgctgtatctgcaaatgaacagcctgagagccgaggacacggctgtgtattattgtgcgagagatcgattcgatttttggagtggttattccgactactggggccagggaaccctggtcaccgtctcctca

SEQ ID NO: 30682 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAIIWYDGSYKYYADSVKGRFTISRDNSKNTLYLQMNSLRAEDTAVYYCARDRFDFWSGYSDYWGQGTLVTVSS

SEQ ID NO: 30683 - DNA, 348 bp, Artificial Sequence
  Description of Artificial Sequence: Synthetic polynucleotide
caggtgcaactggtggagtctgggggaggcttggtcaagcctggagggtccctgagactctcctgtgcagcctctggattcaccttcagtgactactacatgagctggatccgccaggctccagggaaggggctggagtggctttcatacattagtagtagtggtactaccgtattctacgcagactctgtgaagggccgattcaccatctccagggacaacgccaagaactcactgtatctgcaaatgaacagcctgagagccgaggacacggccgtgtattactgtgcgagagaatgggtgggagccgactactggggccagggaaccctggtcaccgtctcctca

SEQ ID NO: 30684 - protein, 116 aa, Artificial Sequence
  Description of Artificial Sequence: Synthetic polypeptide
QVQLVESGGGLVKPGGSLRLSCAASGFTFSDYYMSWIRQAPGKGLEWLSYISSSGTTVFYADSVKGRFTISRDNAKNSLYLQMNSLRAEDTAVYYCAREWVGADYWGQGTLVTVSS

SEQ ID NO: 30685 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcaacagtggtggttactactggaactggatccgccagcacccagggaagggcctggagtggattgggttcatcttttatagtgggagcacctactacaacccgtccctcaagagtcgagttaccatatcagtagacacgtctaagaaccagttctccctgaagctgaactctgtgactgccgcggacacggccgtgtattactgtgcgagaggggattacgatggttcggggagttatcactactattacggtatggacgtctggggccaagggaccacggtcaccgtctcctca

SEQ ID NO: 30686 - protein, 127 aa, Artificial Sequence
  Description of Artificial Sequence: Synthetic polypeptide
QVQLQESGPGLVKPSQTLSLTCTVSGGSINSGGYYWNWIRQHPGKGLEWIGFIFYSGSTYYNPSLKSRVTISVDTSKNQFSLKLNSVTAADTAVYYCARGDYDGSGSYHYYYGMDVWGQGTTVTVSS

SEQ ID NO: 30687 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaggttataaaaactatgtagactccgtgaagggccgattcaccatctccagagacaattccaagaacacgctgtatctgcaaatgaatagcctgagagctgaggacacggctgtgtattactgtgcgagaggtacccacgggtactactacggtgtggacgtctggggccaagggaccacggtcaccgtctcctca

SEQ ID NO: 30688 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVISYDGGYKNYVDSVKGRFTISRDNSKNTLYLQMNSLRAEDTAVYYCARGTHGYYYGVDVWGQGTTVTVSS

SEQ ID NO: 30689 - DNA, 360 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcagctattagtggtcgtggtggtaacacatactacgcagactccgtgaagggccggttcaccatctccagagacaattccaagaacacgctgtatctgcaaatgaacagtttgagagccgaggacacggccgtatattactgtgcgaaagatggattcggtgggagctcctattttgactactggggccagggaaccctggtcaccgtctcctca

SEQ ID NO: 30690 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGNTYYADSVKGRFTISRDNSKNTLYLQMNSLRAEDTAVYYCAKDGFGGSSYFDYWGQGTLVTVSS

SEQ ID NO: 30691 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagcacccagggaagggcctggagtggattgggtacatcttttacagtgggagcacctactacaacccgtccctcaagagtcgagttaccatatcagtagacacgtctaagaaccagttctccctgaagctgagctctgtgactgccgcggacacggccgtatattactgtgcgagaggggattacgatggttcggggagttatcactactactacggtatggacgtctggggccaagggaccacggtcaccgtctcctca

SEQ ID NO: 30692 - protein, 127 aa, Artificial Sequence; identical to SEQ ID NO: 30630
  Description of Artificial Sequence: Synthetic polypeptide

SEQ ID NO: 30693 - DNA, 381 bp, Artificial Sequence
  Description of Artificial Sequence: Synthetic polynucleotide
caggtgcagctgcaggagtcgggcccaggactggtgaacccttcacagaccctgtccctcacctgcactgtctctggtggctccatcagcagtggtgtttactactggagctggatccgccagcacccagggaagggcctggagtggattgggaacatctattacagtgggagcacctacaacaacccgtccctcaagagtcgaattatcatatcagtagacacgtctaagaaccagttctccctgaagctgagctctgtgactgccgcggacacggccgtgtattactgtgcgagaggggattacgatggttcggggagttatcactactactacggtttggacgtctggggccaagggaccacggtcaccgtctcctca

SEQ ID NO: 30694 - protein, 127 aa, Artificial Sequence
  Description of Artificial Sequence: Synthetic polypeptide
QVQLQESGPGLVNPSQTLSLTCTVSGGSISSGVYYWSWIRQHPGKGLEWIGNIYYSGSTYNNPSLKSRIIISVDTSKNQFSLKLSSVTAADTAVYYCARGDYDGSGSYHYYYGLDVWGQGTTVTVSS

SEQ ID NO: 30695 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggaaacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcccatagcagtggctggtacatctttgactactggggccagggaaccctggtcaccgtctcctca

SEQ ID NO: 30696 - protein, 118 aa, Artificial Sequence
  Description of Artificial Sequence: Synthetic polypeptide
QVQLVQSGAEVKKPGASVKVSCKASGNTFTNYDINWVRQATGQGLEWMGWMNPNSGNTGYAQKFQGRVTMTRNTSISTAYMELSSLRSEDTAVYYCAHSSGWYIFDYWGQGTLVTVSS

SEQ ID NO: 30697 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcaataattactactggagctggatccggcagcccgccgggaagggactggagtggattgggcgtatctatgccagtgggagcaccaactacaacccctccctcaagagtcgagtcaccatgtcaatagacacgtccaagaaccagttctccctgaagctgagctctgtgaccgccgcggacacggccgtgtattactgtgcgagagatcggggatactatggctactacggtatggacgtctggggccaagggaccacggtcaccatctcctca

SEQ ID NO: 30698 - protein, 120 aa, Artificial Sequence
  Description of Artificial Sequence: Synthetic polypeptide
QVQLQESGPGLVKPSETLSLTCTVSGGSINNYYWSWIRQPAGKGLEWIGRIYASGSTNYNPSLKSRVTMSIDTSKNQFSLKLSSVTAADTAVYYCARDRGYYGYYGMDVWGQGTTVTISS

SEQ ID NO: 30699 - DNA, 360 bp, Artificial Sequence; identical to SEQ ID NO: 28165
  Description of Artificial Sequence: Synthetic polynucleotide

SEQ ID NO: 30700 - protein, 120 aa, Artificial Sequence; identical to SEQ ID NO: 28166
  Description of Artificial Sequence: Synthetic polypeptide

SEQ ID NO: 30701 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctttatcatgcactgggtccgccaggctccaggcagggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggagtatagcagtggctggttcgggtacggtatggacgtctggggccaagggaccacggtcaccgtctcctca

SEQ ID NO: 30702 - protein, 123 aa, Artificial Sequence
  Description of Artificial Sequence: Synthetic polypeptide
QVQLVESGGGVVQPGRSLRLSCAASGFTFSSFIMHWVRQAPGRGLEWVAVIWYDGSNKYYADSVKGRFTISRDNSKNTLYLQMNSLRAEDTAVYYCAREEYSSGWFGYGMDVWGQGTTVTVSS

SEQ ID NO: 30703 - DNA, 348 bp, Artificial Sequence; identical to SEQ ID NO: 30683
  Description of Artificial Sequence: Synthetic polynucleotide

SEQ ID NO: 30704 - protein, 116 aa, Artificial Sequence; identical to SEQ ID NO: 30684
  Description of Artificial Sequence: Synthetic polypeptide

SEQ ID NO: 30705 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaatagtggtaatacaggctatgcacagaagttccagggcagagtcaccatgaccaggaatacctccataagcacagcctacatggagctgagcagcctgagatctgaggacacggccgtgtattactgtgcgagtagcagtggctggtacttctttgactactggggccagggaaccctggtcaccgtctcctca

SEQ ID NO: 30706 - protein, 118 aa, Artificial Sequence; identical to SEQ ID NO: 29120
  Description of Artificial Sequence: Synthetic polypeptide

SEQ ID NO: 30707 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagaagttaccactggagttggatccggcagcccgccgggaagggactggagtggattgggcatatctataccagtaggagcaccaactacaacccctccctcaagagtcgagtcaccatttcagtagacacgtccaagaaccagttctccctgaagctgagctctgtgaccgccacggacacggccgtgtattactgtgcgagactccggtataactggaacttcccttactttgactactggggccagggaaccctggtcaccgtctcctca

SEQ ID NO: 30708 - protein, 120 aa, Artificial Sequence
  Description of Artificial Sequence: Synthetic polypeptide
QLQLQESGPGLVKPSETLSLTCTVSGGSIRSYHWSWIRQPAGKGLEWIGHIYTSRSTNYNPSLKSRVTISVDTSKNQFSLKLSSVTATDTAVYYCARLRYNWNFPYFDYWGQGTLVTVSS

SEQ ID NO: 30709 - DNA, 369 bp, Artificial Sequence
  Description of Artificial Sequence: Synthetic polynucleotide
gaggtgcagctgttggactctgggggaggcttgggacagcctggggggtccctgagactctcctgtgcagcctctggattcacctttgacagctatgccatgagttgggtccgccaggctccagggaaggggctggagtgggtctcaactattagtggtactggtcgtaggacatactacgcagactccgtgaagggccggttcaccatctccagagacaattccaagaacacgctgtatctgcaaatgaatagcctgagagccgaggacacggccgtatattactgtgcgaaagaggaggattactatgatagtagtggcccggggttcgacccctggggccagggaaccctggtcaccgtctcctca

SEQ ID NO: 30710 - protein, 123 aa, Artificial Sequence
  Description of Artificial Sequence: Synthetic polypeptide
EVQLLDSGGGLGQPGGSLRLSCAASGFTFDSYAMSWVRQAPGKGLEWVSTISGTGRRTYYADSVKGRFTISRDNSKNTLYLQMNSLRAEDTAVYYCAKEEDYYDSSGPGFDPWGQGTLVTVSS

SEQ ID NO: 30711 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacttatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatcagggcgtgggctacgacggtttggacgtctggggccaagggaccacggtcaccgtctcctca

SEQ ID NO: 30712 - protein, 120 aa, Artificial Sequence
  Description of Artificial Sequence: Synthetic polypeptide
QVQLVESGGGVVQPGRSLRLSCAASGFTFSTYGMHWVRQAPGKGLEWVAVIWYDGSNKNYADSVKGRFTISRDNSKNTLYLQMNSLRAEDTAVYYCARDQGVGYDGLDVWGQGTTVTVSS

SEQ ID NO: 30713 - DNA, 369 bp, Artificial Sequence
  Description of Artificial Sequence: Synthetic polynucleotide
ggggtacaactgttggactctgggggaggcttgggacagcctggggggtccctgagactctcctgtgcagcctctggattcacctttgacagctatgccatgagctgggtccgccaggctccagggaaggggctggagtgggtctcaactattagtggtactggtcgtaggacatattacgcagactccgtgaagggccggttcaccatctccagagacaattccaagaacacactgtatctgcagatgaatagcctgagagccgaggacacggccgtatattactgtgcgaaagaggaggattactatgatagtagtggcccggggttcgacccctggggccagggaaccctggtcaccgtctcctca

SEQ ID NO: 30714 - protein, 123 aa, Artificial Sequence
  Description of Artificial Sequence: Synthetic polypeptide
GVQLLDSGGGLGQPGGSLRLSCAASGFTFDSYAMSWVRQAPGKGLEWVSTISGTGRRTYYADSVKGRFTISRDNSKNTLYLQMNSLRAEDTAVYYCAKEEDYYDSSGPGFDPWGQGTLVTVSS

SEQ ID NO: 30715 - DNA, 360 bp, Artificial Sequence; identical to SEQ ID NO: 30617
  Description of Artificial Sequence: Synthetic polynucleotide

SEQ ID NO: 30716 - protein, 120 aa, Artificial Sequence; identical to SEQ ID NO: 30618
  Description of Artificial Sequence: Synthetic polypeptide

SEQ ID NO: 30717 - DNA, 381 bp, Artificial Sequence
  Description of Artificial Sequence: Synthetic polynucleotide
caggtgcaactgcaggagtcgggcccaggactggtgaagccttcacagaccctgtccctcacctgcactgtctctggtggctccatcaacagtggtgattactactggaactggatccgccagcacccagggaagggcctggagtggattgggtacatcttttacagtgggagcacctactacaacccgtccctcaagagtcgagttaccatatcagtagacacgtctaagaaccagttctccctgaagctgagctctgtgactgccgcggacacggccgtgtattactgtgcgagaggggattacgatggttcggggagttatcactactattacggtatggacgtctggggccaagggaccacggtcaccgtctcctca

SEQ ID NO: 30718 - protein, 127 aa, Artificial Sequence
  Description of Artificial Sequence: Synthetic polypeptide
QVQLQESGPGLVKPSQTLSLTCTVSGGSINSGDYYWNWIRQHPGKGLEWIGYIFYSGSTYYNPSLKSRVTISVDTSKNQFSLKLSSVTAADTAVYYCARGDYDGSGSYHYYYGMDVWGQGTTVTVSS

SEQ ID NO: 30719 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtttgatggaagtaatcaatactatgccgactccgtgaagggccgattcaccatctccagagacaattccaagaacacgctgtatctgcaattgaacagcctgagagccgaggacacggctgtctattactgtgcgagagcccacggggtctactactacgctatggacgtctggggccaagggaccacggtcaccgtctcctca

SEQ ID NO: 30720 - protein, 120 aa, Artificial Sequence
  Description of Artificial Sequence: Synthetic polypeptide
QVQLVESGGGVVQPGRSLRLSCAASGFTFSNYGMHWVRQAPGKGLEWVAIIWFDGSNQYYADSVKGRFTISRDNSKNTLYLQLNSLRAEDTAVYYCARAHGVYYYAMDVWGQGTTVTVSS

SEQ ID NO: 30721 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggaactggatccgccagcacccagggaagggcctggattggattggatatatctattacagtgggagcacctactacaacccgtccctcaagagtcgagttaccatatcagtagacacgtctaagaaccagttctccctgaagctgaactctgtgactgccgcggacacggccgtgtattactgtgcgagatccgggtataattgggacgccggggtcgacccctggggccagggaaccctggtcaccgtctcctca

SEQ ID NO: 30722 - protein, 121 aa, Artificial Sequence
  Description of Artificial Sequence: Synthetic polypeptide
QVQLQESGPGLVKPSQTLSLTCTVSGGSISSGGYYWNWIRQHPGKGLDWIGYIYYSGSTYYNPSLKSRVTISVDTSKNQFSLKLNSVTAADTAVYYCARSGYNWDAGVDPWGQGTLVTVSS

SEQ ID NO: 30723 - DNA, 360 bp, Artificial Sequence; identical to SEQ ID NO: 30655
  Description of Artificial Sequence: Synthetic polynucleotide

SEQ ID NO: 30724 - protein, 120 aa, Artificial Sequence; identical to SEQ ID NO: 30656
  Description of Artificial Sequence: Synthetic polypeptide

SEQ ID NO: 30725 - DNA, 360 bp, Artificial Sequence; identical to SEQ ID NO: 30655
  Description of Artificial Sequence: Synthetic polynucleotide

SEQ ID NO: 30726 - protein, 120 aa, Artificial Sequence; identical to SEQ ID NO: 30656
  Description of Artificial Sequence: Synthetic polypeptide

SEQ ID NO: 30727 - DNA, 348 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtactaccgtattctacgcagactctgtgaagggccgattcaccatctccagggacaacgccaagaactcactgtatctgcaaatgaacagcctgagagccgaggacacggccgtgtattactgtgcgagagaatgggtgggagccgactactggggccagggaaccctggtcaccgtctcctca

SEQ ID NO: 30728 - protein, 116 aa, Artificial Sequence
  Description of Artificial Sequence: Synthetic polypeptide
QVQLVESGGGLVKPGGSLRLSCAASGFTFSDYYMSWIRQAPGKGLEWVSYISSSGTTVFYADSVKGRFTISRDNAKNSLYLQMNSLRAEDTAVYYCAREWVGADYWGQGTLVTVSS

SEQ ID NO: 30729 - DNA, 360 bp, Artificial Sequence; identical to SEQ ID NO: 30601
  Description of Artificial Sequence: Synthetic polynucleotide

SEQ ID NO: 30730 - protein, 120 aa, Artificial Sequence; identical to SEQ ID NO: 30602
  Description of Artificial Sequence: Synthetic polypeptide

SEQ ID NO: 30731 - DNA, 381 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtggctggcagttatatggtatgatggaagttataaatactatgcagactccgtgaagggccgattcaccatctccagagacaattccaagaacacgctgtatctgcaaatgaacagcctgagagccgaggacacggctgtgtattactgtgcgagagaggattccccttatagtggctacgccttggactacttctacggtatggacgtctggggccaagggaccacggtcaccgtctcctca

SEQ ID NO: 30732 - protein, 127 aa, Artificial Sequence
  Description of Artificial Sequence: Synthetic polypeptide
QVQLVESGGGVVQPGRSLRLSCAASGFTFSSYGMHWVRQAPGKGLEWLAVIWYDGSYKYYADSVKGRFTISRDNSKNTLYLQMNSLRAEDTAVYYCAREDSPYSGYALDYFYGMDVWGQGTTVTVSS

SEQ ID NO: 30733 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacatgttgtatctgcaaatgaacagcctgagagccgaggaaacggctgtgtattactgtgcgagagatcgtggggttggctactacggtatggacgtctggggccaagggaccacggtcaccgtctcctca

SEQ ID NO: 30734 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNMLYLQMNSLRAEETAVYYCARDRGVGYYGMDVWGQGTTVTVSS

SEQ ID NO: 30735 - DNA, 363 bp, Artificial Sequence
  Description of Artificial Sequence: Synthetic polynucleotide
gaggtgcagctgttggaatctgggggagacttaatacagcctggggggtccctgagactctcctgtgcagcctctggattcacctttagcagctctgccatgagctgggtccgccaggctccagggaaggggctggagtgggtctcagccattagtggtagtggtggtaacacattctacgcagactccgtgaagggccggttcaccatctccagagacaattccaagaacacgctgtatctgcaaatgaacagcctgagagccgaagacacggccgtttattactgtgcgaaactcatagcagtagttgggtcccactactttgactactggggccagggaaccctggtcaccgtctcctca

SEQ ID NO: 30736 - protein, 121 aa, Artificial Sequence
  Description of Artificial Sequence: Synthetic polypeptide
EVQLLESGGDLIQPGGSLRLSCAASGFTFSSSAMSWVRQAPGKGLEWVSAISGSGGNTFYADSVKGRFTISRDNSKNTLYLQMNSLRAEDTAVYYCAKLIAVVGSHYFDYWGQGTLVTVSS

SEQ ID NO: 30737 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagcacccagggaagggcctggaatggattgggttcatcttttacagtgggagcacctactacaacccgtccctcaagagtcgagttaccatatcagtagacacgtctaagaaccagttctccctgaagctgagctctgtgactgtcgcggacacggccgtgtattactgtgcgagaggggattacgatggttcggggagttatcaccactactacggtatggacgtctggggccaagggaccacggtcaccgtctcctca

SEQ ID NO: 30738 - protein, 127 aa, Artificial Sequence
  Description of Artificial Sequence: Synthetic polypeptide
QVQLQESGPGLVKPSQTLSLTCTVSGGSISSGDYYWNWIRQHPGKGLEWIGFIFYSGSTYYNPSLKSRVTISVDTSKNQFSLKLSSVTVADTAVYYCARGDYDGSGSYHHYYGMDVWGQGTTVTVSS

SEQ ID NO: 30739 - DNA, 360 bp, Artificial Sequence; identical to SEQ ID NO: 30627
  Description of Artificial Sequence: Synthetic polynucleotide

SEQ ID NO: 30740 - protein, 120 aa, Artificial Sequence; identical to SEQ ID NO: 30628
  Description of Artificial Sequence: Synthetic polypeptide

SEQ ID NO: 30741 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtgttagttactactggagctggatccgccagcgcccagggaagggcctggagtggattgggaacctctattacagtgggagcacctactacaacccgtccctcaggagtcgagctaccatatcagtagacacgtctaagaaccagttctccctgaagctgagttctgtgactgccgcggacacggccgtgtattactgtacgagaggggattacgatggttcggggagttatcactactaccacggtatggacgtctggggccaagggaccacggtcaccgtctcctca

SEQ ID NO: 30742 - protein, 127 aa, Artificial Sequence
  Description of Artificial Sequence: Synthetic polypeptide
QVQLQESGPGLVKPSQTLSLTCTVSGGSISSVSYYWSWIRQRPGKGLEWIGNLYYSGSTYYNPSLRSRATISVDTSKNQFSLKLSSVTAADTAVYYCTRGDYDGSGSYHYYHGMDVWGQGTTVTVSS

SEQ ID NO: 30743 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcagttatatggtatgatggaagtaacaaaaactatgtagactccgtgaggggccgattcaccatctccagagacaactccaagaacacgctgtatctgcaaatgaacagcctgagagccgaggacacggctgtgtattattgtgcgagagatagaagcgtcggctacgacggtatggacgtctggggccaagggaccacggtcaccgtctcctca

SEQ ID NO: 30744 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYVDSVRGRFTISRDNSKNTLYLQMNSLRAEDTAVYYCARDRSVGYDGMDVWGQGTTVTVSS

SEQ ID NO: 30745 - DNA, 360 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagcaataaaaactatgcagactccgtgaagggccgattcaccatctccagagacaattccaagaacacgctgtatctgcaaatgaacagcctgagagccgaggacacggctgtgtattactgtgcgagagatcaaggtgtggggtactacggtatggacgtctggggccaagggaccacggtcaccgtctcctca

SEQ ID NO: 30746 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDQGVGYYGMDVWGQGTTVTVSS

SEQ ID NO: 30747 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtgactccatcaataatggtggatactactggagctggatccgccagcacccagggaagggcctggagtggattggatacatcttttacagcgggagcacctactacaacccgtccctcaagagtcgagttaccatatcagttgacacgtctaagaatcagttctccctgaaactgaactctgtgactgccgcggacacggccgtgtatttttgtgcgagagcgggatataactgggacaacgggtttgactactggggccagggaaccctggtcaccgtctcctca

SEQ ID NO: 30748 - protein, 121 aa, Artificial Sequence
  Description of Artificial Sequence: Synthetic polypeptide
QVQLQESGPGLVKPSQTLSLTCTVSGDSINNGGYYWSWIRQHPGKGLEWIGYIFYSGSTYYNPSLKSRVTISVDTSKNQFSLKLNSVTAADTAVYFCARAGYNWDNGFDYWGQGTLVTVSS

SEQ ID NO: 30749 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctttatcatgcactgggtccgccaggctccaggcagggggctggagtgggtggcagttatatggtatgatggaagtaataaatactatgtagactccgtgaagggccgattcaccatctccagagacaattccaagaacacgctgtatctgcaaatgaacagcctgagagccgaggacacggctgtgtactactgtgcgagagaggagtatagtagcggctggttcgggtacggtatggacgtctggggccaagggaccacggtcaccgtctcctca

SEQ ID NO: 30750 - protein, 123 aa, Artificial Sequence
  Description of Artificial Sequence: Synthetic polypeptide
QVQLVESGGGVVQPGRSLRLSCAASGFTFSSFIMHWVRQAPGRGLEWVAVIWYDGSNKYYVDSVKGRFTISRDNSKNTLYLQMNSLRAEDTAVYYCAREEYSSGWFGYGMDVWGQGTTVTVSS

SEQ ID NO: 30751 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttttatggtatgatggaactaataaaaactatgcagactccgtgaagggccgattcaccatctccagagacaattccaagaacacgctgtatctgcaaatgaacagcctgagagccgaggacacggctgtgtattactgtgcgagagatcagggcgtgggctacgacggtttggacgtctggggccaagggaccacggtcaccgtctcctca

SEQ ID NO: 30752 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVLWYDGTNKNYADSVKGRFTISRDNSKNTLYLQMNSLRAEDTAVYYCARDQGVGYDGLDVWGQGTTVTVSS

SEQ ID NO: 30753 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatatcatatgatggaggttataaaaactatgcagactccgtgaagggccgattcaccatctccagagacaattccaagaacacgctgtatctgcaaatgaatagcctgagagctgaggacacggctgtgtattactgtgcgagaggtacccacgggtactactacggtgtggacgtctggggccaagggaccacggtcaccgtctcctca

SEQ ID NO: 30754 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVTVISYDGGYKNYADSVKGRFTISRDNSKNTLYLQMNSLRAEDTAVYYCARGTHGYYYGVDVWGQGTTVTVSS

SEQ ID NO: 30755 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatgaacactatgcagactccgtgaagggccgattcatgatctccagagacaattccaagaacacgctgtatctgcaaatgaacagcctgagagccgaggacacggctgtgtattactgtgcgagagataggggagtgggttactacggtatggacgtctggggccaagggaccacggtcaccgtctcctca

SEQ ID NO: 30756 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNEHYADSVKGRFMISRDNSKNTLYLQMNSLRAEDTAVYYCARDRGVGYYGMDVWGQGTTVTVSS

SEQ ID NO: 30757 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgctactggagctggatccgccagcccccagggaaggggctggagtggattggggaaatcaatcaaagtggaaggtccaactacaacccgtccctcaagagtcgagtcaccatttcagtagacacgtccacgaaccagttctccctgaagctgagatctgtgaccgccgcggacacggctgtgtattactgtgcgagagactacggtgtctttgactactggggccagggcaccctggtcaccgtctcctca

SEQ ID NO: 30758 - protein, 115 aa, Artificial Sequence
  Description of Artificial Sequence: Synthetic polypeptide
QVQLQQWGAGLLKPSETLSLTCAVYGGSFSGCYWSWIRQPPGKGLEWIGEINQSGRSNYNPSLKSRVTISVDTSTNQFSLKLRSVTAADTAVYYCARDYGVFDYWGQGTLVTVSS

SEQ ID NO: 30759 - DNA, 360 bp, Artificial Sequence; identical to SEQ ID NO: 30601
  Description of Artificial Sequence: Synthetic polynucleotide

SEQ ID NO: 30760 - protein, 120 aa, Artificial Sequence; identical to SEQ ID NO: 30602
  Description of Artificial Sequence: Synthetic polypeptide

SEQ ID NO: 30761 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagaagctaccactggagctggatccggcagcccgccgggaagggactggagtggattgggcttatctataccagtaggagcaccaattacaacccctccctcaagagtcgagtcaccatgtcagttgacacgtccaagaaccagttctccctgaagctgaactctgtgaccgccgcggacacggccgtgtattactgtgcgagactccggtataactggaacttcccttactttgactactggggccagggaaccctggtcaccgtctcctca

SEQ ID NO: 30762 - protein, 120 aa, Artificial Sequence; identical to SEQ ID NO: 30636
  Description of Artificial Sequence: Synthetic polypeptide

SEQ ID NO: 30763 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcatcgtctggattcaccttcaggaactatggcatgcactgggtccgccaggctccaggcaaggggctgaaatgggtggcagttatatggtttgatggaagtaatgactactatgcagactccgtgaagggccgattcaccatctccagagacaattccaagaacacgctgtcactgcaaatgaacagcctgagagccgaggacacggctgtgtattactgtgcgagagatagaagcgtcggctacgacggtttagatgtctggggccaagggaccacggtcaccgtctcctca

SEQ ID NO: 30764 - protein, 120 aa, Artificial Sequence
  Description of Artificial Sequence: Synthetic polypeptide
QVQLVESGGGVVQPGRSLRLSCASSGFTFRNYGMHWVRQAPGKGLKWVAVIWFDGSNDYYADSVKGRFTISRDNSKNTLSLQMNSLRAEDTAVYYCARDRSVGYDGLDVWGQGTTVTVSS

SEQ ID NO: 30765 - DNA, 363 bp, Artificial Sequence
  Description of Artificial Sequence: Synthetic polynucleotide
gaggtgcagctgttggagtctgggggaggcttggtacagcctggggggtccctgagactctcctgttcagcctctggattcacctttagcagctatgccatgagctgggtccgccaggctccagggaaggggctggagtgggtctcagctattagtggtagaggcggtagtacattctacgcagactccgtgaagggccggttcaccatctccagagacaattccaagaacacgctgtatctgcaaatgaacagcctgagagccgaggacacggccgtctattactgtgcgcgacgtttagcactggatggctatgatgcttttgatatctggggccaagggacaatggtcaccgtctcttca

SEQ ID NO: 30766 - protein, 121 aa, Artificial Sequence
  Description of Artificial Sequence: Synthetic polypeptide
EVQLLESGGGLVQPGGSLRLSCSASGFTFSSYAMSWVRQAPGKGLEWVSAISGRGGSTFYADSVKGRFTISRDNSKNTLYLQMNSLRAEDTAVYYCARRLALDGYDAFDIWGQGTMVTVSS

SEQ ID NO: 30767 - DNA, 360 bp, Artificial Sequence; identical to SEQ ID NO: 30655
  Description of Artificial Sequence: Synthetic polynucleotide

SEQ ID NO: 30768 - protein, 120 aa, Artificial Sequence; identical to SEQ ID NO: 30656
  Description of Artificial Sequence: Synthetic polypeptide

SEQ ID NO: 30769 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgtttaccactggagctggatccgccagcacccagggaagggcctggagtggattgggaacatccattacagcgggagcacctacaacaacccgtccctcaagagtcgagttaccatatcagtagacacgtctaagaaccagttctccctgaagctgagctctgtgactgccgcggacacggccgtgtattactgtgcgagaggggattacgatggttcggggagttatcactactactacggtatggacgtctggggccaagggaccacggtcaccgtctcctca

SEQ ID NO: 30770 - protein, 127 aa, Artificial Sequence
  Description of Artificial Sequence: Synthetic polypeptide
QVQLQESGPGLVKPSQTLSLTCTVSGGSISSGVYHWSWIRQHPGKGLEWIGNIHYSGSTYNNPSLKSRVTISVDTSKNQFSLKLSSVTAADTAVYYCARGDYDGSGSYHYYYGMDVWGQGTTVTVSS

SEQ ID NO: 30771 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgtttactactggagctggatccgccagcacccagggaagggcctggagtggattgggaacatctattacagtgggagcacctacaacaacccgtccctcaagagtcgacttaccatatcagcagacacgtctaagaaccagttctccctgaagctgagctctgtgactgccgcggacacggccgtgtattactgtgcgagaggggattacgatggttcggggagttatcactactactacggtatggacgtctggggccaagggaccacggtcaccgtctcctca

SEQ ID NO: 30772 - protein, 127 aa, Artificial Sequence
  Description of Artificial Sequence: Synthetic polypeptide
QVQLQESGPGLVKPSQTLSLTCTVSGGSISSGVYYWSWIRQHPGKGLEWIGNIYYSGSTYNNPSLKSRLTISADTSKNQFSLKLSSVTAADTAVYYCARGDYDGSGSYHYYYGMDVWGQGTTVTVSS

SEQ ID NO: 30773 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgtttactactggagctggatccgccagcacccagggaagggcctggagtggattgggaacatctattacagtgggagcacctacaacaacccgtccctcaagagtcgagttaccatatcagtagacacgtctaagaaccagttctccctgaagctgagctctgtgactgccgcggacacggccgtgtattactgtgcgagaggggattacgatggttcggggagttatcactactactacggtatggacgtctggggccaagggaccacggtcaccgtctcctca

SEQ ID NO: 30774 - protein, 127 aa, Artificial Sequence
  Description of Artificial Sequence: Synthetic polypeptide
QVQLQESGPGLVKPSQTLSLTCTVSGGSISSGVYYWSWIRQHPGKGLEWIGNIYYSGSTYNNPSLKSRVTISVDTSKNQFSLKLSSVTAADTAVYYCARGDYDGSGSYHYYYGMDVWGQGTTVTVSS

SEQ ID NO: 30775 - DNA, 360 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcacctttgccatgagttgggtccgccaggctccagggaaggggctggagtgggtctcagctattagtcgtagtggtggtaacacacactacgcagactccgtgaagggccggttcaccatctccagagacaattccaagaatacgctgtatctgcaaatgaacagcctgagagccgaggacacggccgtatattcctgtgcgaaagatggattcggtgggagctcctactttgactactggggccagggaaccctggtcaccgtctcctca

SEQ ID NO: 30776 - protein, 120 aa, Artificial Sequence
  Description of Artificial Sequence: Synthetic polypeptide
EVQLLESGGGLVQPGGSLRLSCAASGFTFSTFAMSWVRQAPGKGLEWVSAISRSGGNTHYADSVKGRFTISRDNSKNTLYLQMNSLRAEDTAVYSCAKDGFGGSSYFDYWGQGTLVTVSS

SEQ ID NO: 30777 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagctcccagggaagggcctggagtggattgggtacatcttttacagtgggagcacctactacaacccgtccctcaagagtcgacttaccatatcagtggacacgtctaagaaccagttctccctgaagctgagctctgtgactgccgcggacacggccgtgtattactgtacaaggggggattacgatggttcggggagttatcacttctactacggtatggacgtctggggccaagggaccacggtcaccgtctcctca

SEQ ID NO: 30778 - protein, 127 aa, Artificial Sequence
  Description of Artificial Sequence: Synthetic polypeptide
QVQLQESGPGLVKPSQTLSLTCTVSGGSISSGDYYWNWIRQLPGKGLEWIGYIFYSGSTYYNPSLKSRLTISVDTSKNQFSLKLSSVTAADTAVYYCTRGDYDGSGSYHFYYGMDVWGQGTTVTVSS

SEQ ID NO: 30779 - DNA, 381 bp, Artificial Sequence; identical to SEQ ID NO: 30717
  Description of Artificial Sequence: Synthetic polynucleotide

SEQ ID NO: 30780 - protein, 127 aa, Artificial Sequence; identical to SEQ ID NO: 30718
  Description of Artificial Sequence: Synthetic polypeptide

SEQ ID NO: 30781 - DNA, 363 bp, Artificial Sequence
  Description of Artificial Sequence: Synthetic polynucleotide
gaggtgcagctgttggagtctgggggaggcttggcacagcctggggggtccctgagactctcctgtgcagcctctggattcacctttagcagctatgccatgaactgggtccgccaggctccagggaaggggctggagtgggtctcagctattattggtaatggtggtagaacatactacgcagactccgtgaagggccggttctccatctccagagacaattccaagaacacgctgtttctgcaaatgaacagcctgagagccgaggacacggccgtatattactgtgcgaaagatctgggtagatacagctatggtttctttgactactggggccagggaaccctggtcaccgtctcctca

SEQ ID NO: 30782 - protein, 121 aa, Artificial Sequence
  Description of Artificial Sequence: Synthetic polypeptide
EVQLLESGGGLAQPGGSLRLSCAASGFTFSSYAMNWVRQAPGKGLEWVSAIIGNGGRTYYADSVKGRFSISRDNSKNTLFLQMNSLRAEDTAVYYCAKDLGRYSYGFFDYWGQGTLVTVSS

SEQ ID NO: 30783 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagaacagcctacatggagctgaacagcctgagatctgaggacacggccgtgtattactgtgcgagtagcagtggctggtacttctttgactactggggccagggaaccctggtcaccgtctcctca

SEQ ID NO: 30784 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSIRTAYMELNSLRSEDTAVYYCASSSGWYFFDYWGQGTLVTVSS

SEQ ID NO: 30785 - DNA, 366 bp, Artificial Sequence; identical to SEQ ID NO: 28153
  Description of Artificial Sequence: Synthetic polynucleotide

SEQ ID NO: 30786 - protein, 122 aa, Artificial Sequence; identical to SEQ ID NO: 28154
  Description of Artificial Sequence: Synthetic polypeptide

SEQ ID NO: 30787 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtggctgccgcggacacggccgtgtattattgtgcgagaggagagtataactggaaccacggtatggacgtctggggccaagggaccacggtcaccgtctcctca

SEQ ID NO: 30788 - protein, 121 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVAAADTAVYYCARGEYNWNHGMDVWGQGTTVTVSS

SEQ ID NO: 30789 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctttggtgggtccttcagtggtccctactggagttggatccgccagcccccagggaaggggctggagtggattggggaatccaatcatagtggacgcaccaactacaacccgtccctcaagagtcgagtcaccatatcagtggacacgtccaagaaccagttctccctgaggctgagctctgtgaccgccgcggacacggctgtgtattactgtgcgagagactacggtggtttggactactggggccagggaaccctggtcaccgtctcctca

SEQ ID NO: 30790 - protein, 115 aa, Artificial Sequence
  Description of Artificial Sequence: Synthetic polypeptide
QVQLQQWGAGLLKPSETLSLTCAVFGGSFSGPYWSWIRQPPGKGLEWIGESNHSGRTNYNPSLKSRVTISVDTSKNQFSLRLSSVTAADTAVYYCARDYGGLDYWGQGTLVTVSS

SEQ ID NO: 30791 - DNA, 381 bp, Artificial Sequence; identical to SEQ ID NO: 30717
  Description of Artificial Sequence: Synthetic polynucleotide

SEQ ID NO: 30792 - protein, 127 aa, Artificial Sequence; identical to SEQ ID NO: 30718
  Description of Artificial Sequence: Synthetic polypeptide

SEQ ID NO: 30793 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactacgcagactccgtgaagggccgattcaccatctccagagacaattccaagaacacgctgtatctgcaaatgaacagcctgagagccgaggacacggctatgtattactgtgcgagagatcagggcgtgggctacgacggcttggacgtctggggccaagggacctcggtcaccgtctcctca

SEQ ID NO: 30794 - protein, 120 aa, Artificial Sequence; identical to SEQ ID NO: 30656
  Description of Artificial Sequence: Synthetic polypeptide

SEQ ID NO: 30795 - DNA, 342 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttacttctggacctggatccgccagcccccagggaaggggctggagtggattggggaaatcaatcatagtggaagcaccaactacaacccgtccctcaagagtcgcgtcaccatatcagtagacacgtccaagaaccagttctccctgaagctgagctctgtgaccgccgcggacacggctgtgtattactgtgcgagagactacggtgctgactactggggccagggaaccctggtcgccgtctccgca

SEQ ID NO: 30796 - protein, 114 aa, Artificial Sequence
  Description of Artificial Sequence: Synthetic polypeptide
QVQLQQWGAGLLKPSETLSLTCAVYGGSFSGYFWTWIRQPPGKGLEWIGEINHSGSTNYNPSLKSRVTISVDTSKNQFSLKLSSVTAADTAVYYCARDYGADYWGQGTLVAVSA

SEQ ID NO: 30797 - DNA, 381 bp, Artificial Sequence; identical to SEQ ID NO: 30629
  Description of Artificial Sequence: Synthetic polynucleotide

SEQ ID NO: 30798 - protein, 127 aa, Artificial Sequence; identical to SEQ ID NO: 30630
  Description of Artificial Sequence: Synthetic polypeptide

SEQ ID NO: 30799 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcaacagtggtggttactactggaactggatccgccagcacccagggaagggcctggagtggattgggttcatcttttacagtgggagcacctactacaacccgtccctcaagagtcgagtttccatatcagtagacacgtctaagaaccagttctccctgaagctgagctctgtgactgccgcggacacggccgtgtattactgtgcgagaggggattacgatggttcggggagttatcactactattacggtatggacgtctggggccaggggaccacggtcaccgtctcctca

SEQ ID NO: 30800 - protein, 127 aa, Artificial Sequence
  Description of Artificial Sequence: Synthetic polypeptide
QVQLQESGPGLVKPSQTLSLTCTVSGGSINSGGYYWNWIRQHPGKGLEWIGFIFYSGSTYYNPSLKSRVSISVDTSKNQFSLKLSSVTAADTAVYYCARGDYDGSGSYHYYYGMDVWGQGTTVTVSS

SEQ ID NO: 30801 - DNA, 381 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtatctatggcatggactgggtccgccaggctccaggcaaggggctggagtgggtggcagttatatggtatgatggaagttataaatactatgcagactccgtgaagggccgattcaccatctccagagacaattccaagaacacgctgtatctgcaaatgaacagcctgagagccgaggacacggctgtgtattattgtgtgagagaggattccccttatagtggctacggcttggactactactacggtatggacgtctggggccaagggaccacggtcaccgtctcctca

SEQ ID NO: 30802 - protein, 127 aa, Artificial Sequence
  Description of Artificial Sequence: Synthetic polypeptide
QVQLVESGGGVVQPGRSLRLSCAASGFTFSIYGMDWVRQAPGKGLEWVAVIWYDGSYKYYADSVKGRFTISRDNSKNTLYLQMNSLRAEDTAVYYCVREDSPYSGYGLDYYYGMDVWGQGTTVTVSS

SEQ ID NO: 30803 - DNA, 381 bp, Artificial Sequence
  Description of Artificial Sequence: Synthetic polynucleotide
caggtgcagctgcaggagaaaggcccaggactggtgaagccttcacagaccctgtccctcacctgcactgtctctggtggctccgtcagcagtggtgtttactactggagctggatccgccagcacccagggaagggcctggagtggattgggaacatctattacagtgggagcacctacaacaacccgtccctcaagagtcgagttaccatatcagtagacacgtctaagaaccagttctccctgaagctgaactctgtgactgccgcggacacggccgtctattactgtgcgcgaggggattacgatggttcggggagttatcacttctactacggtttggacgtctggggccatgggaccacggtcaccgtctcctca

SEQ ID NO: 30804 - protein, 127 aa, Artificial Sequence
  Description of Artificial Sequence: Synthetic polypeptide
QVQLQEKGPGLVKPSQTLSLTCTVSGGSVSSGVYYWSWIRQHPGKGLEWIGNIYYSGSTYNNPSLKSRVTISVDTSKNQFSLKLNSVTAADTAVYYCARGDYDGSGSYHFYYGLDVWGHGTTVTVSS

SEQ ID NO: 30805 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtgactccatcaataatggtggatactactggagctggatccgccagcacccagggaagggcctggagtggattgggtacatcttttacagcgggagcacctactacaacccgtccctcaagagtcgagttaccatatcagttgacacgtctaagaatcagttctccctgaagctgaactctgtgactgccgcggacacggccgtgtatttttgtgcgagagcgggatataactgggacaacgggtttgactactggggccagggaaccctggtcaccgtctcctca

SEQ ID NO: 30806 - protein, 121 aa, Artificial Sequence; identical to SEQ ID NO: 30748
  Description of Artificial Sequence: Synthetic polypeptide

SEQ ID NO: 30807 - DNA, 360 bp, Artificial Sequence; identical to SEQ ID NO: 30627
  Description of Artificial Sequence: Synthetic polynucleotide

SEQ ID NO: 30808 - protein, 120 aa, Artificial Sequence; identical to SEQ ID NO: 30628
  Description of Artificial Sequence: Synthetic polypeptide

SEQ ID NO: 30809 - DNA, 348 bp, Artificial Sequence
  Description of Artificial Sequence: Synthetic polynucleotide
gaggtgcagttggtggagtctgggggaggcctggtcaagcctggggggtccctgagactctcctgtgcagcctctggattcaccttcagggactatagcatgaactgggtccgccaggctccagggaaggggctggagtgggtctcatccattagtagtgctggtggttacatatactacgcagactcactgaagggccgattcaccatctccagagacaacgccaaaaactcactgtatctgcaaatgaacagcctgagagccgaggacacggctgtgtattactgtgcgagagcaactatggcccttgactactggggccagggaaccctggtcaccgtctcctca

SEQ ID NO: 30810 - protein, 116 aa, Artificial Sequence
  Description of Artificial Sequence: Synthetic polypeptide
EVQLVESGGGLVKPGGSLRLSCAASGFTFRDYSMNWVRQAPGKGLEWVSSISSAGGYIYYADSLKGRFTISRDNAKNSLYLQMNSLRAEDTAVYYCARATMALDYWGQGTLVTVSS

SEQ ID NO: 30811 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtgctgattactactggaactggatccgccagctcccagggaagggcctggagtggattgggtacatcttttacagtgggagcacctactacaacccgtccctcaagagtcgacttaccatatcagtggacacgtctaagaaccagttctccctgaagctgagctctgtgactgccgcggacacggccgtgtattactgtgcgagaggggattacgatggttcggggagttatcacttctactacggtatggacgtctggggccaagggaccacggtcaccgtctcctca

SEQ ID NO: 30812 - protein, 127 aa, Artificial Sequence
  Description of Artificial Sequence: Synthetic polypeptide
QVQLQESGPGLVKPSQTLSLTCTVSGGSISSADYYWNWIRQLPGKGLEWIGYIFYSGSTYYNPSLKSRLTISVDTSKNQFSLKLSSVTAADTAVYYCARGDYDGSGSYHFYYGMDVWGQGTTVTVSS

SEQ ID NO: 30813 - DNA, 363 bp, Artificial Sequence
  Description of Artificial Sequence: Synthetic polynucleotide
caggtgcagctggtggagtctgggggaggcgtggtccagcctgggaggtccctgagactctcctgtggagcgtctggattcaccttcagtagctatgccatgcactgggtccgccaggctccaggcaaggggctggagtgggtggcagttatatggtatgatggaactaataaatactatggagactccgtgaagggccgattcaccatctccagagacaattccaagaacacgctgaatctgcaaatgaacagcctgagagccgaggacacggctgtctattactgtgcgagagatttcactataactggagctacatattttgactactggggccagggaaccctggtcaccgtctcctca

SEQ ID NO: 30814 - protein, 121 aa, Artificial Sequence
  Description of Artificial Sequence: Synthetic polypeptide
QVQLVESGGGVVQPGRSLRLSCGASGFTFSSYAMHWVRQAPGKGLEWVAVIWYDGTNKYYGDSVKGRFTISRDNSKNTLNLQMNSLRAEDTAVYYCARDFTITGATYFDYWGQGTLVTVSS

SEQ ID NO: 30815 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatgaacactatgcagactccgtgaagggccgattcaccatctccagagacaattccaagaacacgctgtatctgcaaatgaacagcctgagagccgaggacacggctgtgtattactgtgcgagaaataggggggtgggttactacggtttggacgtctggggccaagggaccacggtcaccgtctcctca

SEQ ID NO: 30816 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNEHYADSVKGRFTISRDNSKNTLYLQMNSLRAEDTAVYYCARNRGVGYYGLDVWGQGTTVTVSS

SEQ ID NO: 30817 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcaataattactactggagctggatccggcagcccgccgggaagggactggagtggattgggcgtatctatgccagtgggagcaccaactacaacccctccctcaagagtcgagtcaccatgtcaatagacacgtccaagaaccagttctccctgaagctgagctctgtgaccgccgcggacacggccgtgcattactgtgcgagagatcggggatactatggctactacggtatggacgtctggggccaagggaccacggtcaccatctcctca

SEQ ID NO: 30818 - protein, 120 aa, Artificial Sequence
  Description of Artificial Sequence: Synthetic polypeptide
QVQLQESGPGLVKPSETLSLTCTVSGGSINNYYWSWIRQPAGKGLEWIGRIYASGSTNYNPSLKSRVTMSIDTSKNQFSLKLSSVTAADTAVHYCARDRGYYGYYGMDVWGQGTTVTISS

SEQ ID NO: 30819 - DNA, 348 bp, Artificial Sequence
  Description of Artificial Sequence: Synthetic polynucleotide
caggtgcagttggtgcaatctgggactgaggtgaagaagcctggggcctctttgaaggtctcctgcaaggcttctggatacaccttcaccgtctactatttgaactgggtgcgacaggcccctggacaagggcttgagtggatgggatggatcaaccctaacagtggtggcacaaactatgcacagaagtttcagggcagggtcaccatgaccagggacacgtccatcagcacagcctacatggaactgagcaggctgagatctgacgacacggccgtgtattactgtgcgagaggctacgatattttgactggttggggccagggaaccctggtcaccgtctcctca

SEQ ID NO: 30820 - protein, 116 aa, Artificial Sequence
  Description of Artificial Sequence: Synthetic polypeptide
QVQLVQSGTEVKKPGASLKVSCKASGYTFTVYYLNWVRQAPGQGLEWMGWINPNSGGTNYAQKFQGRVTMTRDTSISTAYMELSRLRSDDTAVYYCARGYDILTGWGQGTLVTVSS

SEQ ID NO: 30821 - DNA, 360 bp, Artificial Sequence
  Description of Artificial Sequence: Synthetic polynucleotide
cagctgcagctgcaggagtcgggcccaggactggtgaagccttcggagaccctgtccctcacctgcactgtctctggtggctccatcagtagttaccactggagctggatccggcagcccgccgggaagggactggagtggattggacttatctataccagtaggagcaccaactacaacccctccctcaagagtcgagtcaccatgtcagtagacaggtccaagagccagttctccctgaagctgagctctgtgaccgccgcggacacggccgtgtattactgtgcgagactccggtataactggaacttcccttactttgactactggggccagggaaccctggtcaccgtctcctca

SEQ ID NO: 30822 - protein, 120 aa, Artificial Sequence
  Description of Artificial Sequence: Synthetic polypeptide
QLQLQESGPGLVKPSETLSLTCTVSGGSISSYHWSWIRQPAGKGLEWIGLIYTSRSTNYNPSLKSRVTMSVDRSKSQFSLKLSSVTAADTAVYYCARLRYNWNFPYFDYWGQGTLVTVSS

SEQ ID NO: 30823 - DNA, 381 bp, Artificial Sequence
  Description of Artificial Sequence: Synthetic polynucleotide
caggtgcaactgcaggagtcgggcccaggactggtgaagccttcacagaccctgtccctcacctgcactgtctctggtggctccatcaacagtggtgattactactggaactggatccgccaccacccagggaagggcctggagtggattgggtacatcttttacagtgggagcacctactacaacccgtccctcaagagtcgagttaccatatcagtagacacgtctaagaaccagttctccctgaagctgagctctgtgactgccgcggacacggccgtatattactgtgcgagaggggattacgatggttcggggagttatcactactattacggtatggacgtctggggccaagggaccacggtcaccgtctcctca

SEQ ID NO: 30824 - protein, 127 aa, Artificial Sequence
  Description of Artificial Sequence: Synthetic polypeptide
QVQLQESGPGLVKPSQTLSLTCTVSGGSINSGDYYWNWIRHHPGKGLEWIGYIFYSGSTYYNPSLKSRVTISVDTSKNQFSLKLSSVTAADTAVYYCARGDYDGSGSYHYYYGMDVWGQGTTVTVSS

SEQ ID NO: 30825 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtgactccatcaacagtggtgattactactggaactggatccgccagcacccagggaagggcctggagtggattggattcatcttttacagtgggagcacctactacaacccgtccctcaagagtcgagttaccatatcaatagacacgtctaagaaccagttctccctgaagctgagctctgtgaatgtcgcggacacggccgtgtattactgtgcgagaggggattacgatggttcggggagttatcactactattacggtatggacgtctggggccaagggaccacggtcaccgtctcctca

SEQ ID NO: 30826 - protein, 127 aa, Artificial Sequence
  Description of Artificial Sequence: Synthetic polypeptide
QVQLQESGPGLVKPSQTLSLTCTVSGDSINSGDYYWNWIRQHPGKGLEWIGFIFYSGSTYYNPSLKSRVTISIDTSKNQFSLKLSSVNVADTAVYYCARGDYDGSGSYHYYYGMDVWGQGTTVTVSS

SEQ ID NO: 30827 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattattgtgcgagagatcggtctaagggttacgacggtatggacgtctggggccaagggaccacggtcaccgtctcctca

SEQ ID NO: 30828 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDRSKGYDGMDVWGQGTTVTVSS

SEQ ID NO: 30829 - DNA, 381 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactactacatacactgggtgcgacaggcccctggacaagggcttgagtggatgggatggatcaaccctaacaatggtggcacaaactatgcacagaaatttcagggcagggtcaccatgaccagggacacgtccatcagcacagcctacatggagctgagcaggctgagatctgacgacacggccgtgtattactgtgcgagagaaccccttggttactatggttcggggagttatggggcctacggtatggacgtctggggccaagggaccacggtcaccgtctcctca

SEQ ID NO: 30830 - protein, 127 aa, Artificial Sequence
  Description of Artificial Sequence: Synthetic polypeptide
QVQLVQSGAEVKKPGASVKVSCKASGYTFTDYYIHWVRQAPGQGLEWMGWINPNNGGTNYAQKFQGRVTMTRDTSISTAYMELSRLRSDDTAVYYCAREPLGYYGSGSYGAYGMDVWGQGTTVTVSS

SEQ ID NO: 30831 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctctggtgggtccttcagatattactactggagctggatccgccagccccccgggaaggggctggagtggtttggggaaatcaatcatagtggaagcaccaactacaacccgtccctcaagagtcgagtcaccatatcaatagacacgtccaagaaccagttctccctgaagctgaggtctgtgaccgccgcggacacggctgtgtattactgtgcgagagactacggtgcttttgatatctggggccaagggacaatggtcaccgtctcttca

SEQ ID NO: 30832 - protein, 115 aa, Artificial Sequence
  Description of Artificial Sequence: Synthetic polypeptide
QVQLQQWGAGLLKPSETLSLTCAVSGGSFRYYYWSWIRQPPGKGLEWFGEINHSGSTNYNPSLKSRVTISIDTSKNQFSLKLRSVTAADTAVYYCARDYGAFDIWGQGTMVTVSS

SEQ ID NO: 30833 - DNA, 369 bp, Artificial Sequence
  Description of Artificial Sequence: Synthetic polynucleotide
caggtgcagctggtggagtcggggggaggcgtggtccagcctgggaggtccctgagactctcctgtgcagcgtctggattcaccttcagtagctttatcatgcactgggtccgccaggctccaggcagggggctggagtgggtggcagttatatggtatgatggaagtaataaatactatgcagactccgtgaagggccgattcaccatctccagagacaattccaagaacacgctgtatctggaaatgaacagcctgagagtcgaggacacggctgtgtattactgtgcgagagaggagtatagcagtggctggttcgggtacggtatggacgtctggggccaagggaccacggtcaccgtctcctca

SEQ ID NO: 30834 - protein, 123 aa, Artificial Sequence
  Description of Artificial Sequence: Synthetic polypeptide
QVQLVESGGGVVQPGRSLRLSCAASGFTFSSFIMHWVRQAPGRGLEWVAVIWYDGSNKYYADSVKGRFTISRDNSKNTLYLEMNSLRVEDTAVYYCAREEYSSGWFGYGMDVWGQGTTVTVSS

SEQ ID NO: 30835 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatgaacactatgcagactccgtgaagggccgattcaccatctccagagacaattccaagaacacgctgtctctgcaaatgaacagcctgagagccgaggacacggctgtgtattactgtgcgagagataggggggtgggttattacggtttggacgtctggggccaagggaccacggtcaccgtctcctca

SEQ ID NO: 30836 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNEHYADSVKGRFTISRDNSKNTLSLQMNSLRAEDTAVYYCARDRGVGYYGLDVWGQGTTVTVSS

SEQ ID NO: 30837 - DNA, 360 bp, Artificial Sequence; identical to SEQ ID NO: 30617
  Description of Artificial Sequence: Synthetic polynucleotide

SEQ ID NO: 30838 - protein, 120 aa, Artificial Sequence; identical to SEQ ID NO: 30618
  Description of Artificial Sequence: Synthetic polypeptide

SEQ ID NO: 30839 - DNA, 345 bp, Artificial Sequence
  Description of Artificial Sequence: Synthetic polynucleotide
caggtgcagttacagcagtggggcgcaggactgttgaagccttcggagaccctgtccctcacctgcgctgtctctggtgggtccttcagatattacttctggagctggatccgccagtcccccgggaaggggctggagtggtttggggaaatcaatcatagtggacgcaccaactacaacccgtccctcaagagtcgagtcaccatatcagtagacacgtccaagaaccagttctccctgaagctgaggtctgtgaccgccgcggacacggctgtgtattactgtgcgagagactacggtgcttttgatatctggggccaaggcacattggtcaccgtctcttca

SEQ ID NO: 30840 - protein, 115 aa, Artificial Sequence
  Description of Artificial Sequence: Synthetic polypeptide
QVQLQQWGAGLLKPSETLSLTCAVSGGSFRYYFWSWIRQSPGKGLEWFGEINHSGRTNYNPSLKSRVTISVDTSKNQFSLKLRSVTAADTAVYYCARDYGAFDIWGQGTLVTVSS

SEQ ID NO: 30841 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactatgtcatgcactgggtccgccaggctccaggcaaggggctggagtgggtggcagttatttggtatgatggaactaataaatactatgcagactccgtgaagggccgattcaccatctccagagacaattccaagaacacgctgtatctgcaaatgaacagcctgagagccgaggacacggctgtgtattactgtgcgagagattggttcggggaggggaactactacggtatggacgtctggggccaagggaccacggtcaccgtctcctca

SEQ ID NO: 30842 - protein, 122 aa, Artificial Sequence
  Description of Artificial Sequence: Synthetic polypeptide
QVQLVESGGGVVQPGRSLRLSCAASGFTFSHYVMHWVRQAPGKGLEWVAVIWYDGTNKYYADSVKGRFTISRDNSKNTLYLQMNSLRAEDTAVYYCARDWFGEGNYYGMDVWGQGTTVTVSS

SEQ ID NO: 30843 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtgactccatcagcagcggtggttactactggagctggatccgccagcacccagggaagggcctggagtggattgggtacagctattacagtgggagcaccaactataacccgtccctcaagagtcgagttaccatatcagtagacatgtctaagaaccagttctccctgaagctgagctctgtgactgacgcggacacggccgtgtattattgtgcgagaggggggtataactggaacaacgggtttgactactggggccagggagccctggtcaccgtctcctca

SEQ ID NO: 30844 - protein, 121 aa, Artificial Sequence
  Description of Artificial Sequence: Synthetic polypeptide
QVQLQESGPGLVKPSQTLSLTCTVSGDSISSGGYYWSWIRQHPGKGLEWIGYSYYSGSTNYNPSLKSRVTISVDMSKNQFSLKLSSVTDADTAVYYCARGGYNWNNGFDYWGQGALVTVSS

SEQ ID NO: 30845 - DNA, 360 bp, Artificial Sequence; identical to SEQ ID NO: 30601
  Description of Artificial Sequence: Synthetic polynucleotide

SEQ ID NO: 30846 - protein, 120 aa, Artificial Sequence; identical to SEQ ID NO: 30602
  Description of Artificial Sequence: Synthetic polypeptide

SEQ ID NO: 30847 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagctcccagggaagggcctggagtggattgggtacatcttttacagtgggagcacctactacaacccgtccctcaagagtcgacttaccatatcagtggacacgtctaagaaccagttctccctgaagctgagctctgtgactgccgcggacacggccgtgtattactgtgcgagaggggattacgatggttcggggagttatcacttctactacggtatggacgtctggggccaagggaccacggtcaccgtctcctca

SEQ ID NO: 30848 - protein, 127 aa, Artificial Sequence
  Description of Artificial Sequence: Synthetic polypeptide
QVQLQESGPGLVKPSQTLSLTCTVSGGSISSGDYYWNWIRQLPGKGLEWIGYIFYSGSTYYNPSLKSRLTISVDTSKNQFSLKLSSVTAADTAVYYCARGDYDGSGSYHFYYGMDVWGQGTTVTVSS

SEQ ID NO: 30849 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctgcagtgggtggcagttatatggtatgatggaagtaatgaacactatgcagactccgtgaagggccgattcaccatctccagagacaattccaagaacacgctgtatctgcaaatgaacagcctgagagccgaggacacggctgtgtattactgtgcgagagataggggggtgggttactacggtttggacgtctggggccaagggaccacggtcaccgtctcctca

SEQ ID NO: 30850 - protein, 120 aa, Artificial Sequence
  Description of Artificial Sequence: Synthetic polypeptide
QVQLVESGGGVVQPGRSLRLSCAASGFTFSSYGMHWVRQAPGKGLQWVAVIWYDGSNEHYADSVKGRFTISRDNSKNTLYLQMNSLRAEDTAVYYCARDRGVGYYGLDVWGQGTTVTVSS

SEQ ID NO: 30851 - DNA, 366 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaatggctacaattcaggtactactacggtatggacgtctggggccaagggaccacggtcaccgtctcctca

SEQ ID NO: 30852 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREWLQFRYYYGMDVWGQGTTVTVSS

SEQ ID NO: 30853 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcaatagtggttactactggagctggatccgccagcacccagggaagggcctggaatggattgggtacatgtattacagtgggagcacctactacaacccgtccctcaagagtcgggttaccatatctgtagacacgtctaagaaccagttttatctgaagctgagcgctgtgactgccgcggacacggccgtgtattactgtgcgaaaggggggtataactggaacaatgggtttgactgttggggccagggaaccctggtcaccgtctcctca

SEQ ID NO: 30854 - protein, 121 aa, Artificial Sequence
  Description of Artificial Sequence: Synthetic polypeptide
QVQLQESGPGLVKPSQTLSLTCTVSGGSISNSGYYWSWIRQHPGKGLEWIGYMYYSGSTYYNPSLKSRVTISVDTSKNQFYLKLSAVTAADTAVYYCAKGGYNWNNGFDCWGQGTLVTVSS

SEQ ID NO: 30855 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtggctgccgcggacacggccgtgtattattgtgcgagaggggggtataactggaaccacggtatggacgtctggggccaagggaccacggtcaccgtctcctca

SEQ ID NO: 30856 - protein, 121 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVAAADTAVYYCARGGYNWNHGMDVWGQGTTVTVSS

SEQ ID NO: 30857 - DNA, 348 bp, Artificial Sequence; identical to SEQ ID NO: 30683
  Description of Artificial Sequence: Synthetic polynucleotide

SEQ ID NO: 30858 - protein, 116 aa, Artificial Sequence; identical to SEQ ID NO: 30684
  Description of Artificial Sequence: Synthetic polypeptide

SEQ ID NO: 30859 - DNA, 360 bp, Artificial Sequence; identical to SEQ ID NO: 30657
  Description of Artificial Sequence: Synthetic polynucleotide

SEQ ID NO: 30860 - protein, 120 aa, Artificial Sequence; identical to SEQ ID NO: 30658
  Description of Artificial Sequence: Synthetic polypeptide

SEQ ID NO: 30861 - DNA, 348 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagtagtggtattaccatgtactacgcagactctgtgaagggccgattcaccatctccagggacaacgccaagaactcactgtatctgcaaatgaacagcctgagagccgaggacacggccgtgtattactgtgcgagagaatgggtgggagccgactactggggccagggaaccctggtcaccgtctcctca

SEQ ID NO: 30862 - protein, 116 aa, Artificial Sequence
  Description of Artificial Sequence: Synthetic polypeptide
QVQLVESGGGLVKPGGSLRLSCAASGFTFSDYYMSWIRQAPGKGLEWISYISSSGITMYYADSVKGRFTISRDNAKNSLYLQMNSLRAEDTAVYYCAREWVGADYWGQGTLVTVSS

SEQ ID NO: 30863 - DNA, 348 bp, Artificial Sequence; identical to SEQ ID NO: 30683
  Description of Artificial Sequence: Synthetic polynucleotide

SEQ ID NO: 30864 - protein, 116 aa, Artificial Sequence; identical to SEQ ID NO: 30684
  Description of Artificial Sequence: Synthetic polypeptide

SEQ ID NO: 30865 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctttggcatgcactgggtccgccaggctccaggcaaggggctggagtgggtggcagttatattaaatgatggaagtaataaaaagtgtgcagactccgtgaagggccgatgcaccatttccagagacaactccaagaacacgctgtatctgcaaatgaacagcctgagagctgaggacacggctgtttattactgtgcgagaggacagcagtggctggtaaacggtgtggacgtctggggccaggggaccacggtcaccgtctcctca

SEQ ID NO: 30866 - protein, 120 aa, Artificial Sequence
  Description of Artificial Sequence: Synthetic polypeptide
QVQLVESGGGVVQPGRSLRLSCAASGFTFSSFGMHWVRQAPGKGLEWVAVILNDGSNKKCADSVKGRCTISRDNSKNTLYLQMNSLRAEDTAVYYCARGQQWLVNGVDVWGQGTTVTVSS

SEQ ID NO: 30867 - DNA, 372 bp, Artificial Sequence
  Description of Artificial Sequence: Synthetic polynucleotide
gaggtgcagctgttggagtctgggggaggcttggtacagcctggggggtccctgagattctcctgtgcagcctctggattcacctttagcagctgtgccatgacctgggtccgccaggctccagggaaggggctggagtgggtctcagctattagtggtagtggtggtagcacatactacgcagactccgtgaagggccggttcaccatttccagagacaattccaagaacacgctgtatctgcaaatgaacagcctgagagccgaggacacggccgtatattactgtgcgaaagtggggggtttgactggctcctactactactacggtatggacgtctggggccaagggaccacggtcaccgtctcctca

SEQ ID NO: 30868 - protein, 124 aa, Artificial Sequence
  Description of Artificial Sequence: Synthetic polypeptide
EVQLLESGGGLVQPGGSLRFSCAASGFTFSSCAMTWVRQAPGKGLEWVSAISGSGGSTYYADSVKGRFTISRDNSKNTLYLQMNSLRAEDTAVYYCAKVGGLTGSYYYYGMDVWGQGTTVTVSS

SEQ ID NO: 30869 - DNA, 360 bp, Artificial Sequence; identical to SEQ ID NO: 30627
  Description of Artificial Sequence: Synthetic polynucleotide

SEQ ID NO: 30870 - protein, 120 aa, Artificial Sequence; identical to SEQ ID NO: 30628
  Description of Artificial Sequence: Synthetic polypeptide

SEQ ID NO: 30871 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactggatgcggcaggccactggtcaagggcttgagtggatgggatggatgcaccttaacagtggtaacacaggctatgcaccgaagttccagggcagagtcaccatgaccagggacacctccataagcacagccttcatggagctgagcagcctgagatctgaggacacggccgtgtattactgtgcctatagcggtggctggtacgtgttcgacccctggggccagggaaccctggtcaccgtctcctca

SEQ ID NO: 30872 - protein, 118 aa, Artificial Sequence
  Description of Artificial Sequence: Synthetic polypeptide
QVQLVQSGAEVKKPGASVKVSCKASGYTFTNYDINWMRQATGQGLEWMGWMHLNSGNTGYAPKFQGRVTMTRDTSISTAFMELSSLRSEDTAVYYCAYSGGWYVFDPWGQGTLVTVSS

SEQ ID NO: 30873 - DNA, 372 bp, Artificial Sequence
  Description of Artificial Sequence: Synthetic polynucleotide
caggtgcagctggtgcagtctggggctgaggtgaagaagcctggggcctcaatgaaggtctcctgcaaggcttctggatacaccttcaccggctactatatgcactgggtgcgacaggcccctggacaagggcttgagtggatgggatggatcaaccctaacagtggtggcacaaactttgcacagaagtttcggggcagggtcaccatgaccagggacacgtccatcagcacagcctacatggagctgagcaggctgagctctgacgacacggccgtgtattactgtgcgagagggggggttcggggagttcccaactactactacgttatggacgtctggggccaagggaccacggtcaccgtctcctca

SEQ ID NO: 30874 - protein, 124 aa, Artificial Sequence
  Description of Artificial Sequence: Synthetic polypeptide
QVQLVQSGAEVKKPGASMKVSCKASGYTFTGYYMHWVRQAPGQGLEWMGWINPNSGGTNFAQKFRGRVTMTRDTSISTAYMELSRLSSDDTAVYYCARGGVRGVPNYYYVMDVWGQGTTVTVSS

SEQ ID NO: 30875 - DNA, 366 bp, Artificial Sequence; identical to SEQ ID NO: 30841
  Description of Artificial Sequence: Synthetic polynucleotide

SEQ ID NO: 30876 - protein, 122 aa, Artificial Sequence; identical to SEQ ID NO: 30842
  Description of Artificial Sequence: Synthetic polypeptide

SEQ ID NO: 30877 - DNA, 366 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatgaggagtggtggtgactactggagctggatccgccagcacccagggaagggcctggagtggtttgggttcatctattacagtgggagcacctactacaatccgtccctcaagagtcgagttaccttatcagtagacacgtctaagaaccagttctccctgaagctgagctctgtgactgccgcggacacggccgtgtattactgtgcgagaatggactacagtaactactactacggtatggacgtctggggccaagggaccacggtcaccgtctcctca

SEQ ID NO: 30878 - protein, 122 aa, Artificial Sequence
  Description of Artificial Sequence: Synthetic polypeptide
QVQLQESGPGLVKPSQTLSLTCTVSGGSMRSGGDYWSWIRQHPGKGLEWFGFIYYSGSTYYNPSLKSRVTLSVDTSKNQFSLKLSSVTAADTAVYYCARMDYSNYYYGMDVWGQGTTVTVSS

SEQ ID NO: 30879 - DNA, 348 bp, Artificial Sequence; identical to SEQ ID NO: 30597
  Description of Artificial Sequence: Synthetic polynucleotide

SEQ ID NO: 30880 - protein, 116 aa, Artificial Sequence; identical to SEQ ID NO: 30598
  Description of Artificial Sequence: Synthetic polypeptide

SEQ ID NO: 30881 - DNA, 366 bp, Artificial Sequence; identical to SEQ ID NO: 28153
  Description of Artificial Sequence: Synthetic polynucleotide

SEQ ID NO: 30882 - protein, 122 aa, Artificial Sequence; identical to SEQ ID NO: 28154
  Description of Artificial Sequence: Synthetic polypeptide

SEQ ID NO: 30883 - DNA, 381 bp, Artificial Sequence; identical to SEQ ID NO: 30693
  Description of Artificial Sequence: Synthetic polynucleotide

SEQ ID NO: 30884 - protein, 127 aa, Artificial Sequence; identical to SEQ ID NO: 30694
  Description of Artificial Sequence: Synthetic polypeptide

SEQ ID NO: 30885 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaagggactggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatcagggcgtgggctacgacggtttggacgtctggggccaagggaccacggtcaccgtctcctca

SEQ ID NO: 30886 - protein, 120 aa, Artificial Sequence; identical to SEQ ID NO: 30602
  Description of Artificial Sequence: Synthetic polypeptide

SEQ ID NO: 30887 - DNA, 360 bp, Artificial Sequence
  Description of Artificial Sequence: Synthetic polynucleotide
caggtgcaactggtggagtctgggggaggcgtggtccagcctgggaggtccctgagactctcctgtgtagcgtctgggttcaccttcagtagccatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatccctctgtagggtacgacggtatggacgtctggggccaagggaccacggtcaccgtctcctca

SEQ ID NO: 30888 - protein, 120 aa, Artificial Sequence
  Description of Artificial Sequence: Synthetic polypeptide
QVQLVESGGGVVQPGRSLRLSCVASGFTFSSHGMHWVRQAPGKGLEWVAVIWYDGSNKNYADSVKGRFTISRDNSKNTLYLQMNSLRAEDTAVYYCARDPSVGYDGMDVWGQGTTVTVSS

SEQ ID NO: 30889 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagcacccagggaagggcctggagtggattgggtacatcttttacagtgggagcacctactacaacccgtccctcaagagtcgaattaccatatcagtagacacgtctaagaaccagttctccctgaagctgagctctgtgactgccgcggacacggccgtgtattactgtgcgagaggggattacgatggttcggggagttatcactactactacggtttggacgtctggggccaagggaccacggtcaccgtctcctca

SEQ ID NO: 30890 - protein, 127 aa, Artificial Sequence
  Description of Artificial Sequence: Synthetic polypeptide
QVQLQESGPGLVKPSQTLSLTCTVSGGSISSGDYYWNWIRQHPGKGLEWIGYIFYSGSTYYNPSLKSRITISVDTSKNQFSLKLSSVTAADTAVYYCARGDYDGSGSYHYYYGLDVWGQGTTVTVSS

SEQ ID NO: 30891 - DNA, 354 bp, Artificial Sequence; identical to SEQ ID NO: 30623
  Description of Artificial Sequence: Synthetic polynucleotide

SEQ ID NO: 30892 - protein, 118 aa, Artificial Sequence; identical to SEQ ID NO: 30624
  Description of Artificial Sequence: Synthetic polypeptide

SEQ ID NO: 30893 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactacgcagactccgtgaagggccgattcaccatctccagagacaattccaagaacatgttgtatctgcaaatgaacagcctgagagccgaggacacggctatgtattactgtgcgagagatcagggcgtgggctacgacggtttggacgtctggggccaagggacctcggtcaccgtctcctca

SEQ ID NO: 30894 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNMLYLQMNSLRAEDTAMYYCARDQGVGYDGLDVWGQGTSVTVSS

SEQ ID NO: 30895 - DNA, 354 bp, Artificial Sequence; identical to SEQ ID NO: 30623
  Description of Artificial Sequence: Synthetic polynucleotide

SEQ ID NO: 30896 - protein, 118 aa, Artificial Sequence; identical to SEQ ID NO: 30624
  Description of Artificial Sequence: Synthetic polypeptide

SEQ ID NO: 30897 - DNA, 372 bp, Artificial Sequence
  Description of Artificial Sequence: Synthetic polynucleotide
gaggtgcaactattggagtctgggggaggcttggtgcagcctggggggtccctgagactctcctgtgcagcctctggattcacctttagcagctctgccatgacctgggtccgccaggctccagggaagggactggagtgggtctcagctatcattggtaatggtggtagagcatactacgcagactccgtgaagggccggttcaccatctccagagacaattccaagaacacgctgtatctgcaaatgaacagcctgagaaccgaggacacggccgtatattactgtgcgaaagatcggggatatagcaggatagcagtggctggtacctttgactactggggccagggaaccctggtcaccgtctcctca

SEQ ID NO: 30898 - protein, 124 aa, Artificial Sequence
  Description of Artificial Sequence: Synthetic polypeptide
EVQLLESGGGLVQPGGSLRLSCAASGFTFSSSAMTWVRQAPGKGLEWVSAIIGNGGRAYYADSVKGRFTISRDNSKNTLYLQMNSLRTEDTAVYYCAKDRGYSRIAVAGTFDYWGQGTLVTVSS

SEQ ID NO: 30899 - DNA, 360 bp, Artificial Sequence
  Description of Artificial Sequence: Synthetic polynucleotide
caggtgcatctgcaggagtcgggcccaggactggtgaagccttcggagaccctgtccctcacctgcactgtctctggtggctccatcagtgcttactcctggagctggatccggcagcccgccgggaagggactggagtggattgggcgtctctctcctggtgggagcaccaacttcaacccctccctcaagagtcgagtcaccatgtcagtagacacgtccaagaaccagttctccctgaggctgagctctgtgaccgccgcggacacggccgtttattactgtgcgagactccggtataactggaacttcccttactttgactactggggccagggagccctggtcaccgtctcctca

SEQ ID NO: 30900 - protein, 120 aa, Artificial Sequence
  Description of Artificial Sequence: Synthetic polypeptide
QVHLQESGPGLVKPSETLSLTCTVSGGSISAYSWSWIRQPAGKGLEWIGRLSPGGSTNFNPSLKSRVTMSVDTSKNQFSLRLSSVTAADTAVYYCARLRYNWNFPYFDYWGQGALVTVSS

SEQ ID NO: 30901 - DNA, 363 bp, Artificial Sequence
  Description of Artificial Sequence: Synthetic polynucleotide
gaggtgcagctgttggagtctgggggaggcttggcacagccgggggggtccctgagactctcctgtgcagcctctggattcacctttaggagctatgccatgagctgggtccgccaggctccagggaaggggctggagtgggtctcagttattagtggtagaggtggtaacacatactacgcagactccgtgaagggccggttcaccatctccagagacaattccaagaacacgctgtatctgcaaatgaacagcctgagagccgaggacacggccgtatattactgtgcgaaaggcatagcagtggctggctcgcactactttgactactggggccagggaaccctggtcaccgtctcctca

SEQ ID NO: 30902 - protein, 121 aa, Artificial Sequence
  Description of Artificial Sequence: Synthetic polypeptide
EVQLLESGGGLAQPGGSLRLSCAASGFTFRSYAMSWVRQAPGKGLEWVSVISGRGGNTYYADSVKGRFTISRDNSKNTLYLQMNSLRAEDTAVYYCAKGIAVAGSHYFDYWGQGTLVTVSS

SEQ ID NO: 30903 - DNA, 366 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagctatggcatgcactgggtccgccaggctccaggcaaggggctggagtgggtggcagttacatggtatgatggaagtaataaatactatgcagactccgtgaagggccgattcaccatctccagagacaattccaagaacacgctgtatctgcaaatgaacagcctgagagccgaggacacggctgtgtattactgtgcgagagaatggctacaatttaggtactactacggtatagacgtctggggccaagggaccacggtcaccgtctcctca

SEQ ID NO: 30904 - protein, 122 aa, Artificial Sequence
  Description of Artificial Sequence: Synthetic polypeptide
QVQLVESGGGVVQPGRSLRLSCVASGFTFSSYGMHWVRQAPGKGLEWVAVTWYDGSNKYYADSVKGRFTISRDNSKNTLYLQMNSLRAEDTAVYYCAREWLQFRYYYGIDVWGQGTTVTVSS

SEQ ID NO: 30905 - DNA, 360 bp, Artificial Sequence; identical to SEQ ID NO: 30617
  Description of Artificial Sequence: Synthetic polynucleotide

SEQ ID NO: 30906 - protein, 120 aa, Artificial Sequence; identical to SEQ ID NO: 30618
  Description of Artificial Sequence: Synthetic polypeptide

SEQ ID NO: 30907 - DNA, 360 bp, Artificial Sequence; identical to SEQ ID NO: 30885
  Description of Artificial Sequence: Synthetic polynucleotide

SEQ ID NO: 30908 - protein, 120 aa, Artificial Sequence; identical to SEQ ID NO: 30602
  Description of Artificial Sequence: Synthetic polypeptide

SEQ ID NO: 30909 - DNA, 381 bp, Artificial Sequence
  Description of Artificial Sequence: Synthetic polynucleotide
caggtgcaactgaaggagtcgggcccaggactggtgaagccttcacagaccctgtccctcacctgcactgtctctggtggctccatcaacagtggtgattactactggaactggttccgccagcacccagggaagggcctggagtggattgggtacatcttccacagtgggagcacctactacaacccgtccctcaagagtcgagtaaccgtatcagtagacacgtctaagaaccagttctccctgaagctgagttctgtgactgccgcggacacggccgtgtattactgtgcgagaggggattacgatggttcggggagttatcactactattacggtatggacgtctggggccgagggaccacggtcaccgtctcctca

SEQ ID NO: 30910 - protein, 127 aa, Artificial Sequence
  Description of Artificial Sequence: Synthetic polypeptide
QVQLKESGPGLVKPSQTLSLTCTVSGGSINSGDYYWNWFRQHPGKGLEWIGYIFHSGSTYYNPSLKSRVTVSVDTSKNQFSLKLSSVTAADTAVYYCARGDYDGSGSYHYYYGMDVWGRGTTVTVSS

SEQ ID NO: 30911 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcaacagtggtggttactactggaactggatccgccagcacccagggaagggcctggagtggattgggttcatcttttacagtgggagcacctactacaacccgtccctcaagagtcgactttccatatcagtagacacgtctaagaaccagttctccctgaagctgagctctgtgactgccgcggacacggccgtgtattactgtgcgagaggggattacgatggttcggggagttatcactactattacggtatggacgtctggggccaagggaccacggtcaccgtctcctca

SEQ ID NO: 30912 - protein, 127 aa, Artificial Sequence
  Description of Artificial Sequence: Synthetic polypeptide
QVQLQESGPGLVKPSQTLSLTCTVSGGSINSGGYYWNWIRQHPGKGLEWIGFIFYSGSTYYNPSLKSRLSISVDTSKNQFSLKLSSVTAADTAVYYCARGDYDGSGSYHYYYGMDVWGQGTTVTVSS

SEQ ID NO: 30913 - DNA, 381 bp, Artificial Sequence
  Description of Artificial Sequence: Synthetic polynucleotide
caggtgcagctgcaggagtcgggcccaggactggtgaagccctcacagaccctatccctcacctgcactgtctctggtggctccatcagcagtggtggttactactggagctggatccgccagcacccagggaagggcctggagtggattgggaacatctattacagtgggagcacctactacaacccgtccctcaagagtcgagttaccatatcagtagacacgtctaagaaccagttctccctgaagctgagctctgtgactgccgcggacacggccgtgtattactgtgcgagaggggattactatggttcggggagttatcacaactactacggtttggacgtctggggccaagggaccacggtcaccgtctcctca

SEQ ID NO: 30914 - protein, 127 aa, Artificial Sequence
  Description of Artificial Sequence: Synthetic polypeptide
QVQLQESGPGLVKPSQTLSLTCTVSGGSISSGGYYWSWIRQHPGKGLEWIGNIYYSGSTYYNPSLKSRVTISVDTSKNQFSLKLSSVTAADTAVYYCARGDYYGSGSYHNYYGLDVWGQGTTVTVSS

SEQ ID NO: 30915 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaacactatgcagactccgtgaagggccgattcaccatctccagagacaattccaagaacacgctgtatctgcaaatgaacagcctgagagccgaggacacggctgtgtattactgtgcgagagatcagggcgtgggctactacggtatggacgtctggggccaagggaccacggtcaccgtctcctca

SEQ ID NO: 30916 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKHYADSVKGRFTISRDNSKNTLYLQMNSLRAEDTAVYYCARDQGVGYYGMDVWGQGTTVTVSS

SEQ ID NO: 30917 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtttgatggaagtaataaatactatgtagactccgtgaagggccgattcaccatctccagagacaattccaagaacacgctgtttctgcaaatgagcagcctgagagccgaggacacggctgtgtattattgcgcgagagaatggctacaattcaggtactactacggtatggacgtctggggccaagggaccacggtcaccgtctcctca

SEQ ID NO: 30918 - protein, 122 aa, Artificial Sequence
  Description of Artificial Sequence: Synthetic polypeptide
QVQLVESGGGVVQPGRSLRLSCAASGFTFSNYGMHWVRQAPGKGLEWVAIIWFDGSNKYYVDSVKGRFTISRDNSKNTLFLQMSSLRAEDTAVYYCAREWLQFRYYYGMDVWGQGTTVTVSS

SEQ ID NO: 30919 - DNA, 360 bp, Artificial Sequence; identical to SEQ ID NO: 30707
  Description of Artificial Sequence: Synthetic polynucleotide

SEQ ID NO: 30920 - protein, 120 aa, Artificial Sequence; identical to SEQ ID NO: 30708
  Description of Artificial Sequence: Synthetic polypeptide

SEQ ID NO: 30921 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggatccgccagctcccagggaagggcctggagtggattgggtacatcttttacagtgggagcacctactacaacccgtccctcaagagtcgacttaccatatcagtggacacgtctaagaaccagttctccctgaagctgagttctgtgactgccgcggacacggccgtgtattactgtgcgagaggggattacgatggttcggggagttatcacttctactacggtatggacgtctggggccaagggaccacggtcaccgtctcctca

SEQ ID NO: 30922 - protein, 127 aa, Artificial Sequence; identical to SEQ ID NO: 30848
  Description of Artificial Sequence: Synthetic polypeptide

SEQ ID NO: 30923 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggctccgccagcacccagagaagggcctggagtggattgggtacatcttttacagtgggagcacctactacaacccgtccctcaagagtcgagttaccatatcagtggacacgtctatgacccagttctccctgaagctgacctctgtgactgccgcggacacggccgtgtattactgtgcgagaggggattacgatggttcggggagttatcactactactacggtatggacgtctggggccaagggaccacggtcaccgtctcctca

SEQ ID NO: 30924 - protein, 127 aa, Artificial Sequence
  Description of Artificial Sequence: Synthetic polypeptide
QVQLQESGPGLVKPSQTLSLTCTVSGGSISSGDYYWNWLRQHPEKGLEWIGYIFYSGSTYYNPSLKSRVTISVDTSMTQFSLKLTSVTAADTAVYYCARGDYDGSGSYHYYYGMDVWGQGTTVTVSS

SEQ ID NO: 30925 - DNA, 342 bp, Artificial Sequence; identical to SEQ ID NO: 30795
  Description of Artificial Sequence: Synthetic polynucleotide

SEQ ID NO: 30926 - protein, 114 aa, Artificial Sequence; identical to SEQ ID NO: 30796
  Description of Artificial Sequence: Synthetic polypeptide

SEQ ID NO: 30927 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatcagggcgtgggctactacggtatggacgtctggggccaagggaccacggtcaccgtctcctca

SEQ ID NO: 30928 - protein, 120 aa, Artificial Sequence; identical to SEQ ID NO: 30746
  Description of Artificial Sequence: Synthetic polypeptide

SEQ ID NO: 30929 - DNA, 360 bp, Artificial Sequence; identical to SEQ ID NO: 30719
  Description of Artificial Sequence: Synthetic polynucleotide

SEQ ID NO: 30930 - protein, 120 aa, Artificial Sequence; identical to SEQ ID NO: 30720
  Description of Artificial Sequence: Synthetic polypeptide

SEQ ID NO: 30931 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtttgatggaagtaataaatactatgcagactccgtgaagggccgattcaccatctccagagacaattccaagaacacgctgtttctgcaaatgagcagcctgagagccgaggacacggctgtgtattactgtgcgagagaatggctacaattcaggtactactacggtatggacgtctggggccaagggaccacggtcaccgtctcctca

SEQ ID NO: 30932 - protein, 122 aa, Artificial Sequence
  Description of Artificial Sequence: Synthetic polypeptide
QVQLVESGGGVVQPGRSLRLSCAASGFTFSNYGMHWVRQAPGKGLEWVAIIWFDGSNKYYADSVKGRFTISRDNSKNTLFLQMSSLRAEDTAVYYCAREWLQFRYYYGMDVWGQGTTVTVSS

SEQ ID NO: 30933 - DNA, 381 bp, Artificial Sequence; identical to SEQ ID NO: 30799
  Description of Artificial Sequence: Synthetic polynucleotide

SEQ ID NO: 30934 - protein, 127 aa, Artificial Sequence; identical to SEQ ID NO: 30800
  Description of Artificial Sequence: Synthetic polypeptide

SEQ ID NO: 30935 - DNA, 381 bp, Artificial Sequence; identical to SEQ ID NO: 30913
  Description of Artificial Sequence: Synthetic polynucleotide

SEQ ID NO: 30936 - protein, 127 aa, Artificial Sequence; identical to SEQ ID NO: 30914
  Description of Artificial Sequence: Synthetic polypeptide

SEQ ID NO: 30937 - DNA, 363 bp, Artificial Sequence
  Description of Artificial Sequence: Synthetic polynucleotide
gaggtgcaactgttggagtctgggggaggcttggtgcagcctggggggtccctgagactctcctgtgcagcctctggattcacctttagcagctatgccatgagctgggtccgccaggctccagggaaggggctggagtgggtctcagctattagtggtagaggcggtaatacattctacgcagactccgtgaggggccggttcaccatctccagagacaattccaagaacacgctgtatctgcaaatgaacagcctgagagccgaggacacggccgtatattactgtgcgcgacgtatagcagtggatggctatgatgcttttgatgtctggggccaagggacaatggtcaccgtctcttca

SEQ ID NO: 30938 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGRGGNTFYADSVRGRFTISRDNSKNTLYLQMNSLRAEDTAVYYCARRIAVDGYDAFDVWGQGTMVTVSS

SEQ ID NO: 30939 - DNA, 366 bp, Artificial Sequence
  Description of Artificial Sequence: Synthetic polynucleotide
caggtgcagctggtggagtctgggggaggcgtggtccagcctggaaggtccctgagactctcctgtgcagcgtctggattcaccttcagtagttatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtacgagagaatggctacaatttaggtattactacggtatggacgtctggggccaagggaccacggtcaccgtctcctca

SEQ ID NO: 30940 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCTREWLQFRYYYGMDVWGQGTTVTVSS

SEQ ID NO: 30941 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggagcaccaactacaacccgtccctcaggagtcgagttaccatatcagtagacacgtctaagaaccagttctccctgaaactgagttctgtgactgccgcggacacggccgtgtattactgtgcgagagccgggtataactggaacaacggtatggacgtctggggccaagggaccacggtcaccgtctcctca

SEQ ID NO: 30942 - protein, 121 aa, Artificial Sequence
  Description of Artificial Sequence: Synthetic polypeptide
QVQLQESGPGLVKPSQTLSLTCTVSGGSISSGGYYWSWIRQHPGKGLEWIGYIFYSGSTNYNPSLRSRVTISVDTSKNQFSLKLSSVTAADTAVYYCARAGYNWNNGMDVWGQGTTVTVSS

SEQ ID NO: 30943 - DNA, 354 bp, Artificial Sequence; identical to SEQ ID NO: 30871
  Description of Artificial Sequence: Synthetic polynucleotide

SEQ ID NO: 30944 - protein, 118 aa, Artificial Sequence; identical to SEQ ID NO: 30872
  Description of Artificial Sequence: Synthetic polypeptide

SEQ ID NO: 30945 - DNA, 360 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcaataattactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagatcggggatactatggctactacggtatggacgtctggggccaagggaccacggtcaccgtctcctca

SEQ ID NO: 30946 - protein, 120 aa, Artificial Sequence
  Description of Artificial Sequence: Synthetic polypeptide
QVQLQESGPGLVKPSETLSLTCTVSGGSINNYYWSWIRQPAGKGLEWIGRIYTSGSTNYNPSLKSRVTMSVDTSKNQFSLKLSSVTAADTAVYYCARDRGYYGYYGMDVWGQGTTVTVSS

SEQ ID NO: 30947 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaggttataaaaactatatagactccgtgaagggccgattcaccatctccagagacaattccaagaacacgctgtatctgcaaatgaacagcctgagagctgaggacacggctgtgttttactgtgcgagaggtacccacgggtactactacggtgtggacgtctggggccaagggaccacggtcaccgtctcctca

SEQ ID NO: 30948 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVISYDGGYKNYIDSVKGRFTISRDNSKNTLYLQMNSLRAEDTAVFYCARGTHGYYYGVDVWGQGTTVTVSS

SEQ ID NO: 30949 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtgattactactggaactggctccgccagcacccagagaagggcctggagtggattgggtacatcttttacagtgggagcacctactacaacccgtccctcaagagtcgaattaccatatcagtggacacgtctatgacccagttctccctgaagctgacctctgtgactgccgcggacacggccgtgtattactgtgcgagaggggattacgatggttcggggagttatcactactactacggtatggacgtctggggccaagggaccacggtcaccgtctcctca

SEQ ID NO: 30950 - protein, 127 aa, Artificial Sequence
  Description of Artificial Sequence: Synthetic polypeptide
QVQLQESGPGLVKPSQTLSLTCTVSGGSISSGDYYWNWLRQHPEKGLEWIGYIFYSGSTYYNPSLKSRITISVDTSMTQFSLKLTSVTAADTAVYYCARGDYDGSGSYHYYYGMDVWGQGTTVTVSS

SEQ ID NO: 30951 - DNA, 342 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttacttctggacctggatacgccagcccccagggaagggactggagtggattggggaaatcagtcatagtggaagcaccaactacaacccgtccctcaagagtcgagtcaccatatcagtagacacgtccaagaaccagttctccctgaaggtgagctctgtgaccgccgcggacacggctgtgtattactgtgcgagggactacggggcggactactggggccagggaaccctggtcaccgtctcctca

SEQ ID NO: 30952 - protein, 114 aa, Artificial Sequence
  Description of Artificial Sequence: Synthetic polypeptide
QVQLQQWGAGLLKPSETLSLTCAVYGGSFSGYFWTWIRQPPGKGLEWIGEISHSGSTNYNPSLKSRVTISVDTSKNQFSLKVSSVTAADTAVYYCARDYGADYWGQGTLVTVSS

SEQ ID NO: 30953 - DNA, 342 bp, Artificial Sequence
  Description of Artificial Sequence: Synthetic polynucleotide
caggtgcagctacagcagtggggcgcaggactgttgaaaccttcggagaccctgtccctcacctgcgctgtcactggtgggtccttcagtggttacttctggacctggatccgccagcccccagggaaggggctggagtggattggggaaatcagtcatagtggacgcaccaactacaacccgtccctcaagagtcgagtcaccatatcaggagacacgtccaagaaccagttctccctgaagctgagctctgtgaccgccgcggacacggctgtgtattactgtgcgagggactacggggcggactactggggccagggaaccctggtcaccgtctcctca

SEQ ID NO: 30954 - protein, 114 aa, Artificial Sequence
  Description of Artificial Sequence: Synthetic polypeptide
QVQLQQWGAGLLKPSETLSLTCAVTGGSFSGYFWTWIRQPPGKGLEWIGEISHSGRTNYNPSLKSRVTISGDTSKNQFSLKLSSVTAADTAVYYCARDYGADYWGQGTLVTVSS

SEQ ID NO: 30955 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctttgatgggtccttcagtccttactactggagctggatccgccagcccccagggaaggggctggagtggattggggaagtcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagactacgggggtttagactactggggccagggagccctggtcaccgtctcctca

SEQ ID NO: 30956 - protein, 115 aa, Artificial Sequence
  Description of Artificial Sequence: Synthetic polypeptide
QVQLQQWGAGLLKPSETLSLTCAVFDGSFSPYYWSWIRQPPGKGLEWIGEVNHSGSTNYNPSLKSRVTISVDTSKNQFSLKLSSVTAADTAVYYCARDYGGLDYWGQGALVTVSS

SEQ ID NO: 30957 - DNA, 366 bp, Artificial Sequence
  Description of Artificial Sequence: Synthetic polynucleotide
caggttcagctggtgcagtctggagctgaggtgaagaagcctggggcctcagtgaaggtctcctgcaaggcttcaggttacacctttaacagctatggtatcagctgggtgcgactggcccctggacaagggcttgagtggatgggatggatcagcgcttataatggtaacacaaagaatgcacagaggttccagggcagagtcaccatgaccacagacacatccacgagcacggcctacatggagctgaggagcctgagatctgacgacacggccgtttattactgtgcgagacacgatttttggagtggttattataagggtatggacgtctggggccaagggaccacggtcaccgtctcctca

SEQ ID NO: 30958 - protein, 122 aa, Artificial Sequence
  Description of Artificial Sequence: Synthetic polypeptide
QVQLVQSGAEVKKPGASVKVSCKASGYTFNSYGISWVRLAPGQGLEWMGWISAYNGNTKNAQRFQGRVTMTTDTSTSTAYMELRSLRSDDTAVYYCARHDFWSGYYKGMDVWGQGTTVTVSS

SEQ ID NO: 30959 - DNA, 363 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataattattatgaagtatctgtgagaagtcgaataaccatcaacccagacacatccaagaaccagttctccctgcagctgaactctgtgactcccgaggacacggctgtatatttctgtgcgagagatcaacggtactacggtatggacgtctggggccaagggaccacggtcaccgtctcctca

SEQ ID NO: 30960 - protein, 121 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNYYEVSVRSRITINPDTSKNQFSLQLNSVTPEDTAVYFCARDQRYYGMDVWGQGTTVTVSS

SEQ ID NO: 30961 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctttggtgggtccatcagtgtttactactggacctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagggactatggtgtctttgattactggggccagggaaccctggtcaccgtctcctca

SEQ ID NO: 30962 - protein, 115 aa, Artificial Sequence
  Description of Artificial Sequence: Synthetic polypeptide
QVQLQQWGAGLLKPSETLSLTCAVFGGSISVYYWTWIRQPPGKGLEWIGEINHSGSTNYNPSLKSRVTISVDTSKNQFSLKLSSVTAADTAVYYCARDYGVFDYWGQGTLVTVSS

SEQ ID NO: 30963 - DNA, 360 bp, Artificial Sequence
  Description of Artificial Sequence: Synthetic polynucleotide
caggtgcagctggtacagtctggggctgaggtgaagaagcctggggcctcagtgaaggtctcctgcaaggcttctggatacaccttcaccggctactatatgcactgggtgcgacaggcccctggacaagggcttgagtggatgggatggatcgaccctaacagtggtggcacaaactatccacagaagtttcagggcagggtcaccatgaccagggacacgtccatcagcacagcctacatggaactgagcaggctgagatctgacgacacggccgtgttttactgtgcgaaagatcaagggtataactggaactcttttgactactggggccagggaaccctggtcaccgtctcctca

SEQ ID NO: 30964 - protein, 120 aa, Artificial Sequence
  Description of Artificial Sequence: Synthetic polypeptide
QVQLVQSGAEVKKPGASVKVSCKASGYTFTGYYMHWVRQAPGQGLEWMGWIDPNSGGTNYPQKFQGRVTMTRDTSISTAYMELSRLRSDDTAVFYCAKDQGYNWNSFDYWGQGTLVTVSS

SEQ ID NO: 30965 - DNA, 342 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttacttctggacctggatacgccagcccccagggaagggactggagtggattggggaaatcagtcatagtggaagcaccaactacaacccgtccctcaagagtcgagtcaccatatcagtagacacgtccaagaaccagttctccctgaaggtgaactctgtgaccgccgcggacacggctgtgtattactgtgcgagggactacggggcggactactggggccagggaaccctggtcaccgtctcctca

SEQ ID NO: 30966 - protein, 114 aa, Artificial Sequence
  Description of Artificial Sequence: Synthetic polypeptide
QVQLQQWGAGLLKPSETLSLTCAVYGGSFSGYFWTWIRQPPGKGLEWIGEISHSGSTNYNPSLKSRVTISVDTSKNQFSLKVNSVTAADTAVYYCARDYGADYWGQGTLVTVSS

SEQ ID NO: 30967 - DNA, 360 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggcatggatcaaccctaatagtggtggcacaaactatgcacagaagtttcagggcagggtcaccatgaccagggacacgtccatcaccacaacctacatggagctgagcaggctgagatctgacgacacggccgtgtattactgtgcgagaggatacagctatggttacaactggttcgacccctggggccagggaaccctggtcaccgtctcctca

SEQ ID NO: 30968 - protein, 120 aa, Artificial Sequence
  Description of Artificial Sequence: Synthetic polypeptide
QVQLVQSGAEVKKPGASVKVSCKASGYTFTGYYIHWVRQAPGQGLEWMAWINPNSGGTNYAQKFQGRVTMTRDTSITTTYMELSRLRSDDTAVYYCARGYSYGYNWFDPWGQGTLVTVSS

SEQ ID NO: 30969 - DNA, 366 bp, Artificial Sequence
  Description of Artificial Sequence: Synthetic polynucleotide
gaggtgcagctgttggagtctgggggaggcttggtacagcctggggggtccctgagactctcctgtgtagcctctggattcacctttagcagctatgccatgagctgggtccgccaggctccagggaaggggctggagtgggtctcaactattagtggtagtggtgttagaacatactacgcagactccgtgaagggccggttcaccatctccagagacaattccaagaacacgctgtttctgcaaatgaacagcctgagagccgaggacacggccgtatattactgtgcgaaagggggagctaggagcagtggctggttccactttgactactggggccagggaaccctggtcaccgtctcctca

SEQ ID NO: 30970 - protein, 122 aa, Artificial Sequence
  Description of Artificial Sequence: Synthetic polypeptide
EVQLLESGGGLVQPGGSLRLSCVASGFTFSSYAMSWVRQAPGKGLEWVSTISGSGVRTYYADSVKGRFTISRDNSKNTLFLQMNSLRAEDTAVYYCAKGGARSSGWFHFDYWGQGTLVTVSS

SEQ ID NO: 30971 - DNA, 375 bp, Artificial Sequence
  Description of Artificial Sequence: Synthetic polynucleotide
caggtgcagctggagcagtctggggctgaggtgaagaagcctggggcctcagtgaaggtctcctgcaaggcttctggatacaccttcaccagttatgatatcaactgggtgcgacaggccacaggacaagggcttgagtggctgggatggatgaaccctaagagaggtaacacaggctatgcacagaagttccagggcagagtcaccatgaccaggaatacctccataagcacagcccacatggagctgagcagcctgagatctgaggacacggccgtgtattactgtgcgagaggaaggtatagcagggaggattactactactattatgatatggacgtctggggccaagggaccacggtcaccgtctcctca

SEQ ID NO: 30972 - protein, 125 aa, Artificial Sequence
  Description of Artificial Sequence: Synthetic polypeptide
QVQLEQSGAEVKKPGASVKVSCKASGYTFTSYDINWVRQATGQGLEWLGWMNPKRGNTGYAQKFQGRVTMTRNTSISTAHMELSSLRSEDTAVYYCARGRYSREDYYYYYDMDVWGQGTTVTVSS

SEQ ID NO: 30973 - DNA, 363 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataattattatgaagtatctgtgaaaagtcgaataaccatcaacccagacacatccaagaaccagttctccctgcagctgaactctgtgactcccgaggacacggctgtatatttctgtgcgagagatcaacggtactacggtatggacgtctggggccaagggaccacggtcaccgtctcctca

SEQ ID NO: 30974 - protein, 121 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNYYEVSVKSRITINPDTSKNQFSLQLNSVTPEDTAVYFCARDQRYYGMDVWGQGTTVTVSS

SEQ ID NO: 30975 - DNA, 363 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgagtatgcagtatctgtgagaagtcgaataaccatcaacccagacacatccaagaaccagttctccctgcagctgaactctgtgactcccgaggacacggctctgtattactgtacaagagatcaacggtactacggtatggacgtctggggccaagggaccccggtcaccgtctcctca

SEQ ID NO: 30976 - protein, 121 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNEYAVSVRSRITINPDTSKNQFSLQLNSVTPEDTALYYCTRDQRYYGMDVWGQGTPVTVSS

SEQ ID NO: 30977 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaactattagtggtagtggtgttagaacatactacgcagactccgtgaagggccggtccaccatctccagagacaattccaagaatacgctgtttctgcaaatgaacagcctgagagccgaggacacggccgtatattactgtgcgaaagggggagctaggagcagtggctggttccactttgactactggggccagggaaccctggtcaccgtctcctca

SEQ ID NO: 30978 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSTISGSGVRTYYADSVKGRSTISRDNSKNTLFLQMNSLRAEDTAVYYCAKGGARSSGWFHFDYWGQGTLVTVSS

SEQ ID NO: 30979 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatgatgggtccttcagtccttactactggagctggatccgccagcccccagggaaggggctggagtggattggggaaatcaatcatagtggaagcaccaactacaatccgtccctcaagagtcgagtcaccatatcagtagacacgtccaagaaccagttctccctgaagctgagctctgtgaccgccgcggacacggctgtatattactgtgcgagagactacgggggtttagactactggggccagggaaccctggtcaccgtctcctca

SEQ ID NO: 30980 - protein, 115 aa, Artificial Sequence
  Description of Artificial Sequence: Synthetic polypeptide
QVQLQQWGAGLLKPSETLSLTCAVYDGSFSPYYWSWIRQPPGKGLEWIGEINHSGSTNYNPSLKSRVTISVDTSKNQFSLKLSSVTAADTAVYYCARDYGGLDYWGQGTLVTVSS

SEQ ID NO: 30981 - DNA, 360 bp, Artificial Sequence
  Description of Artificial Sequence: Synthetic polynucleotide
caggtgcagctggtggagtctgggggaggcgtggtccagcctgggaggtccctgagactctcctgtgaagcgtctggattcaccttcagttactatggcatgcactgggtccgccaggctccaggcaagggactggagtgggtggcaattatatggtatgatggaagtaataaattctatgcagactccgtgaagggccgattcaccatctccagagacagttccaagaacacgctgtatctgcaaatgaacagcctgagagccgaggacacggctgtgtattactgtgcgagtaatatagcagcagctgccccttactttgactactggggccagggaaccctggtcaccgtctcctca

SEQ ID NO: 30982 - protein, 120 aa, Artificial Sequence
  Description of Artificial Sequence: Synthetic polypeptide
QVQLVESGGGVVQPGRSLRLSCEASGFTFSYYGMHWVRQAPGKGLEWVAIIWYDGSNKFYADSVKGRFTISRDSSKNTLYLQMNSLRAEDTAVYYCASNIAAAAPYFDYWGQGTLVTVSS

SEQ ID NO: 30983 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatagaacagttggctacaacggtatggacgtctggggccaagggaccacggtcaccgtctcctca

SEQ ID NO: 30984 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDRTVGYNGMDVWGQGTTVTVSS

SEQ ID NO: 30985 - DNA, 360 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatccactgggtgcgacaggcccctggacaagggcttgagtggatggcatggatcaaccctaatagtggtggcacaaactatgcacagaagtttcagggcagggtcaccatgaccagggacacgtccatcaccacagcctacatggagctgagcaggctgagatctgacgacacggccgtgtattactgtgcgagaggatacagctatggttacaactggttcgacccctggggccagggaaccctggtcaccgtctcctca

SEQ ID NO: 30986 - protein, 120 aa, Artificial Sequence
  Description of Artificial Sequence: Synthetic polypeptide
QVQLVQSGAEVKKPGASVKVSCKASGYTFTGYYIHWVRQAPGQGLEWMAWINPNSGGTNYAQKFQGRVTMTRDTSITTAYMELSRLRSDDTAVYYCARGYSYGYNWFDPWGQGTLVTVSS

SEQ ID NO: 30987 - DNA, 369 bp, Artificial Sequence; identical to SEQ ID NO: 28155
  Description of Artificial Sequence: Synthetic polynucleotide

SEQ ID NO: 30988 - protein, 123 aa, Artificial Sequence; identical to SEQ ID NO: 28156
  Description of Artificial Sequence: Synthetic polypeptide

SEQ ID NO: 30989 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtcaggattcaccctcagtagttttggcatgcactgggtccgccaggctccaggcaaggggctggagtgggtggcagttatatggtatgatgtaaataataaatactatgcagactccgtgaagggccgattcacaatctccagagacaattccaagaacacgctgtatctccaaatgaacagcctgagacccgaggacacggctgtgtattactgtgcgagagaactggggttcctctctgactactggggccagggaatcctggtcaccgtctcctca

SEQ ID NO: 30990 - protein, 117 aa, Artificial Sequence
  Description of Artificial Sequence: Synthetic polypeptide
QVQLVESGGGVVQPGRSLRLSCAASGFTLSSFGMHWVRQAPGKGLEWVAVIWYDVNNKYYADSVKGRFTISRDNSKNTLYLQMNSLRPEDTAVYYCARELGFLSDYWGQGILVTVSS

SEQ ID NO: 30991 - DNA, 348 bp, Artificial Sequence
  Description of Artificial Sequence: Synthetic polynucleotide
caggtgcaactggtggagtctgggggaggcttggtcaagcctggagggtccctgagactctcctgtgcagcctctggattcaccttcagtgactactacatgagctggatccgccaggctccagggaaggggctggagtgggttttatacattagtggtagtggtactaccacatactacgcagactctgtgaagggccgattcaccatctccagggacaacgccaagaactcactgtatctgcaaatgaacagcctgagagccgaggacacggccgtgtattactgtgcgagagatagggggggtttggacgtctggggccaagggaccacggtcaccgtctcctca

SEQ ID NO: 30992 - protein, 116 aa, Artificial Sequence
  Description of Artificial Sequence: Synthetic polypeptide
QVQLVESGGGLVKPGGSLRLSCAASGFTFSDYYMSWIRQAPGKGLEWVLYISGSGTTTYYADSVKGRFTISRDNAKNSLYLQMNSLRAEDTAVYYCARDRGGLDVWGQGTTVTVSS

SEQ ID NO: 30993 - DNA, 354 bp, Artificial Sequence
  Description of Artificial Sequence: Synthetic polynucleotide
caggtgcagctggtgcagtctggggctgcggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcctatagcagtggctggtactactttgactactggggccagggaaccctggtcaccgtctcctca

SEQ ID NO: 30994 - protein, 118 aa, Artificial Sequence
  Description of Artificial Sequence: Synthetic polypeptide
QVQLVQSGAAVKKPGASVKVSCKASGYTFTNYDINWVRQATGQGLEWMGWMHPNSGNTGYAQKFQGRVTMTRNTSISTAYMELSSLRSEDTAVYYCAYSSGWYYFDYWGQGTLVTVSS

SEQ ID NO: 30995 - DNA, 369 bp, Artificial Sequence
  Description of Artificial Sequence: Synthetic polynucleotide
caggtgcagctggtggagtctgggggaggcgtgggccagcctgggaggtccctgagactctcctgtacagcgtctggattcaccttcagtagctatgtcatgcactgggtccgccaggctccaggcaaggggctggagtgggtggcagttatatggtatgatggaagtaataaatataatgcagactccgtgaagggccgattcaccatctccagagacaattccaagaacacgctgtatctgcaaatgaacagcctgagagccgaggacacggctgtgtattactgtgcgagagaaccgtatagcagcagctggtacgactacggtatggacgtctcgggccaagggaccacggtcaccgtctcctca

SEQ ID NO: 30996 - protein, 123 aa, Artificial Sequence
  Description of Artificial Sequence: Synthetic polypeptide
QVQLVESGGGVGQPGRSLRLSCTASGFTFSSYVMHWVRQAPGKGLEWVAVIWYDGSNKYNADSVKGRFTISRDNSKNTLYLQMNSLRAEDTAVYYCAREPYSSSWYDYGMDVSGQGTTVTVSS

SEQ ID NO: 30997 - DNA, 360 bp, Artificial Sequence; identical to SEQ ID NO: 30985
  Description of Artificial Sequence: Synthetic polynucleotide

SEQ ID NO: 30998 - protein, 120 aa, Artificial Sequence; identical to SEQ ID NO: 30986
  Description of Artificial Sequence: Synthetic polypeptide

SEQ ID NO: 30999 - DNA, 363 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataattattatgaagtatctgtgagaagtcgagtaaccatcaacccagacacatccaagaaccagttctccctgcaactgaactctgtgactcccgaggacacggctgtgtatttctgtgcgagagatcaacggtactacggtatggacgtctggggccaagggaccacggtcaccgtctcctca

SEQ ID NO: 31000 - protein, 121 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNYYEVSVRSRVTINPDTSKNQFSLQLNSVTPEDTAVYFCARDQRYYGMDVWGQGTTVTVSS

SEQ ID NO: 31001 - DNA, 372 bp, Artificial Sequence
  Description of Artificial Sequence: Synthetic polynucleotide
gaggtgcaggtgttggagtctgggggaggcttggtgcagcctggggggtccctgcgactctcctgtgcagcctctggattcacctttagcacctatgccatgagctgggtccgccaggctccagggaaggggctggagtgggtctcagctattagtggtagtggtggtagcacatattacgcagactccgtgaagggccggttcaccatctccagagacaattccaagaacacgctgtatctgcaaatggacagcctgagagccgaggacacggccgtatattactgtgcgaaagggataagtggaaccggctcctactactactacggtgtggacgtctggggccaagggaccacggtcaccgtctcctca

SEQ ID NO: 31002 - protein, 124 aa, Artificial Sequence
  Description of Artificial Sequence: Synthetic polypeptide
EVQVLESGGGLVQPGGSLRLSCAASGFTFSTYAMSWVRQAPGKGLEWVSAISGSGGSTYYADSVKGRFTISRDNSKNTLYLQMDSLRAEDTAVYYCAKGISGTGSYYYYGVDVWGQGTTVTVSS

SEQ ID NO: 31003 - DNA, 360 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatcgaggtgtcggctacgacggtatggacgtctggggccaagggaccacggtcaccgtctcctca

SEQ ID NO: 31004 - protein, 120 aa, Artificial Sequence
  Description of Artificial Sequence: Synthetic polypeptide
QVQLVESGGGVVQPGRSLRLSCTASGFTFSSYGMHWVRQAPGKGLEWVAVIWYDGSNKNYADSVKGRFTISRDNSKNTLYLQMNSLRAEDTAVYYCARDRGVGYDGMDVWGQGTTVTVSS

SEQ ID NO: 31005 - DNA, 360 bp, Artificial Sequence
  Description of Artificial Sequence: Synthetic polynucleotide
caggtgcagctggtggagtctgggggagacgtggtccagcctgggaggtccctgagactctcatgtgcagcgtctggattcaccttcagtagctatggcatgcactggggccgccaggctccaggcaaggggctggagtgggtggcagttatatggtatgatggtagcaatgaaaattatgtagcctccgtgaagggccgattcaccatcttcagagacaattccaagaacacgctgtatctgcaaatgaacagcctgagagccgaggacacggctgtgtattactgtgcgagagatctggggatagggtattacggtatggacgtctggggccaagggaccacggtcaccgtctcctca

SEQ ID NO: 31006 - protein, 120 aa, Artificial Sequence
  Description of Artificial Sequence: Synthetic polypeptide
QVQLVESGGDVVQPGRSLRLSCAASGFTFSSYGMHWGRQAPGKGLEWVAVIWYDGSNENYVASVKGRFTIFRDNSKNTLYLQMNSLRAEDTAVYYCARDLGIGYYGMDVWGQGTTVTVSS

SEQ ID NO: 31007 - DNA, 342 bp, Artificial Sequence
  Description of Artificial Sequence: Synthetic polynucleotide
caggtgcagctacagcagtggggcgcaggactgttgaagccttcggagaccctgttcctcacctgcgctgtctatggtgggtccttcagtggttacttctggacctgggtccgccagcccccagggaagggactggagtggattggggaaatcagtcatagtggaagcaccagttacaacccgtccctcaagagtcgagtcaccatatcagtagacaagtccaagaaccagttctccctgaagctgagctctgtgaccgccgcggacacggctgtgtattactgtgcgagggactacggggccgactactggggccagggaaccctggtcaccgtctcctca

SEQ ID NO: 31008 - protein, 114 aa, Artificial Sequence
  Description of Artificial Sequence: Synthetic polypeptide
QVQLQQWGAGLLKPSETLFLTCAVYGGSFSGYFWTWVRQPPGKGLEWIGEISHSGSTSYNPSLKSRVTISVDKSKNQFSLKLSSVTAADTAVYYCARDYGADYWGQGTLVTVSS

SEQ ID NO: 31009 - DNA, 351 bp, Artificial Sequence
  Description of Artificial Sequence: Synthetic polynucleotide
caggtgcagctacagcagtggggcgcaggactgttgaagccttcggagaccctgtccctcacctgcgctgtctttggtgggtccttcagtggtcactactggagctggatccgccagcccccagggaaggggctggagtggattggggaaatgtatcattttggaaacaccaactacaacccgtccctcaagagtcgagtcaccatgtcagtagacacgtccaagaaacagttctccctgaagctgagctctgtgaccgccgcggacacggctgtgtattactgtgcgagagtggggcagtggctggcttttgatatctggggccaagggacaatggtcaccgtctcttca

SEQ ID NO: 31010 - protein, 117 aa, Artificial Sequence
  Description of Artificial Sequence: Synthetic polypeptide
QVQLQQWGAGLLKPSETLSLTCAVFGGSFSGHYWSWIRQPPGKGLEWIGEMYHFGNTNYNPSLKSRVTMSVDTSKKQFSLKLSSVTAADTAVYYCARVGQWLAFDIWGQGTMVTVSS

SEQ ID NO: 31011 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtatattactgtgcgagagatagatcagttggctacgacggtacggacgtctggggccaagggaccacggtcaccgtctcctca

SEQ ID NO: 31012 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRSVGYDGTDVWGQGTTVTVSS

SEQ ID NO: 31013 - DNA, 363 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatattacaggtccaagtggtataattattatgaagtatctgtgagaagtcgaataaccatcaacccagacacatccaagaaccagttctccctgcagctgaattctgtgactcccgaggacacggctgtgtatttctgtgcgagagatcaacggtactacggtatggacgtctggggccaagggaccacggtcaccgtctcctca

SEQ ID NO: 31014 - protein, 121 aa, Artificial Sequence; identical to SEQ ID NO: 30960
  Description of Artificial Sequence: Synthetic polypeptide

SEQ ID NO: 31015 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagatatggcatgcactgggtccgccaggctccaggcaagggactggagtgggtggcagttatatggtatgatggaagtaatgagaattatgtagactccgtgaagggccgattcaccatctccagagacacttccaagaaaatgctgtttctgcaaatgaacagcctgagaaccgatgacacggctgtgtattactgtgcgagagatatggggatagggtattatggtatggacgtctggggccaagggaccacggtcaccgtctcctca

SEQ ID NO: 31016 - protein, 120 aa, Artificial Sequence
  Description of Artificial Sequence: Synthetic polypeptide
QVQLVESGGGVVQPGRSLRLSCAASGFTFSRYGMHWVRQAPGKGLEWVAVIWYDGSNENYVDSVKGRFTISRDTSKKMLFLQMNSLRTDDTAVYYCARDMGIGYYGMDVWGQGTTVTVSS

SEQ ID NO: 31017 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtgtttattactggagctggatccgccagcccccagggaaggggctggagtggattggggaaagcaatcagagtggacgcaccacctacaacccgtccctcaagagtcgagtcaccatatcagtagacacgtccaagaaccagttctccctgaatctgatctctgtgaccgccgcggacacggctgtgtattactgtgcgagggactacggtgtctttgactactggggccagggaaccctggtcaccgtctcctca

SEQ ID NO: 31018 - protein, 115 aa, Artificial Sequence
  Description of Artificial Sequence: Synthetic polypeptide
QVQLQQWGAGLLKPSETLSLTCAVYGGSFSVYYWSWIRQPPGKGLEWIGESNQSGRTTYNPSLKSRVTISVDTSKNQFSLNLISVTAADTAVYYCARDYGVFDYWGQGTLVTVSS

SEQ ID NO: 31019 - DNA, 366 bp, Artificial Sequence
  Description of Artificial Sequence: Synthetic polynucleotide
gaggtgcaactgttggagtctgggggaggcttggtacagcctggggggtcccagagactctcctgtgcagcctctggattcacctttagcagctatgccatgagctgggtccgccaggctccagggaaggggctggagtgggtctcaactattagtggtagtggtgttagaacatactacgcagactccgtgaagggccggttcaccatctccagagacaattccaataacacgctgtttctgcaaatgaacagcctgagagccgaggacacggccgtatattactgtgcgaaagggggagctaggagcagtggctggttccactttgactactggggccagggaaccctggtcaccgtctcctca

SEQ ID NO: 31020 - protein, 122 aa, Artificial Sequence
  Description of Artificial Sequence: Synthetic polypeptide
EVQLLESGGGLVQPGGSQRLSCAASGFTFSSYAMSWVRQAPGKGLEWVSTISGSGVRTYYADSVKGRFTISRDNSNNTLFLQMNSLRAEDTAVYYCAKGGARSSGWFHFDYWGQGTLVTVSS

SEQ ID NO: 31021 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcagctatatggtatgatggaagtaataaatacaatgcagactccgtgaagggccgattcaccatctccagagacaattccaagaacacgctgtatatgcaaatgaacagcctgagagccgaggacacggctgtatactactgtgcgagagatgtgggtacagtgggagctacctactttgactgctggggcccgggaaccctggtcaccgtctcctca

SEQ ID NO: 31022 - protein, 121 aa, Artificial Sequence
  Description of Artificial Sequence: Synthetic polypeptide
QVQLVESGGGVVQPGRSLRLSCAASGFTFSSYAMHWVRQAPGKGLEWVAAIWYDGSNKYNADSVKGRFTISRDNSKNTLYMQMNSLRAEDTAVYYCARDVGTVGATYFDCWGPGTLVTVSS

SEQ ID NO: 31023 - DNA, 342 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttacttctggagctggatccgccagcccccagggaaggggctggagtggattggggaaatcagtcatagtggacgcaccaactacaacccgtccctcaagagccgagtcaccatatcagtagacacgtccaagaaccagttctccctgaaggtgagctctgtgaccgccgcggacacggctgtgtattactgtgcgagggactacggggcggactactggggccagggaaccctggtcaccgtctcctca

SEQ ID NO: 31024 - protein, 114 aa, Artificial Sequence
  Description of Artificial Sequence: Synthetic polypeptide
QVQLQQWGAGLLKPSETLSLTCAVYGGSFSGYFWSWIRQPPGKGLEWIGEISHSGRTNYNPSLKSRVTISVDTSKNQFSLKVSSVTAADTAVYYCARDYGADYWGQGTLVTVSS

SEQ ID NO: 31025 - DNA, 345 bp, Artificial Sequence
  Description of Artificial Sequence: Synthetic polynucleotide
caggtgcagctacagcagcggggcgcaggactgttgaagccttcggagaccctgtccctcacctgcgctgcctatggtgggtccttcagtggtccctactggagctggatccgccagcccccagggaagggcctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtttactactgtgcgagggactacggtgtccttgactactggggccagggaaccctggtcaccgtctcctca

SEQ ID NO: 31026 - protein, 115 aa, Artificial Sequence
  Description of Artificial Sequence: Synthetic polypeptide
QVQLQQRGAGLLKPSETLSLTCAAYGGSFSGPYWSWIRQPPGKGLEWIGEINHSGSTNYNPSLKSRVTISVDTSKNQFSLKLSSVTAADTAVYYCARDYGVLDYWGQGTLVTVSS

SEQ ID NO: 31027 - DNA, 360 bp, Artificial Sequence; identical to SEQ ID NO: 30985
  Description of Artificial Sequence: Synthetic polynucleotide

SEQ ID NO: 31028 - protein, 120 aa, Artificial Sequence; identical to SEQ ID NO: 30986
  Description of Artificial Sequence: Synthetic polypeptide

SEQ ID NO: 31029 - DNA, 360 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcgaccctaatagtggtggcacaaactatgcacagaagtttcagggcagaatcaccatgaccagggacacgtccatcagtacagcctacatggaactgagcaggctgagatctgacgacacggccgtgttttactgtgcgaaagatcaagggtataactggaactcttttgactactggggccagggaaccctggtcaccgtctcctca

SEQ ID NO: 31030 - protein, 120 aa, Artificial Sequence
  Description of Artificial Sequence: Synthetic polypeptide
QVQLVQSGAEVKKPGASVKVSCKASGYTFTGYYIHWVRQAPGQGLEWMGWIDPNSGGTNYAQKFQGRITMTRDTSISTAYMELSRLRSDDTAVFYCAKDQGYNWNSFDYWGQGTLVTVSS

SEQ ID NO: 31031 - DNA, 360 bp, Artificial Sequence; identical to SEQ ID NO: 30985
  Description of Artificial Sequence: Synthetic polynucleotide

SEQ ID NO: 31032 - protein, 120 aa, Artificial Sequence; identical to SEQ ID NO: 30986
  Description of Artificial Sequence: Synthetic polypeptide

SEQ ID NO: 31033 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagagtccgtgaagggccgattcaccatctccagagacaattccaagaacacgctgtatctgcaaatgaacagcctgagagccgaggacacggctgtgtattattgtgcgagagatgcgggtattggatactacggtatagacgtctggggccaagggaccacggtcaccgtctcctca

SEQ ID NO: 31034 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYAESVKGRFTISRDNSKNTLYLQMNSLRAEDTAVYYCARDAGIGYYGIDVWGQGTTVTVSS

SEQ ID NO: 31035 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatagaaataataaatactatggtgactccgtgaagggccgattcaccatctccagagacaattccaagaacacgctgtatctgcaaatgaacagcctgagagccgaggacacggctgtgtattactgtgcgagagaactggggttcctctttgactactggggccagggaaccctggtcaccgtctcctca

SEQ ID NO: 31036 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDRNNKYYGDSVKGRFTISRDNSKNTLYLQMNSLRAEDTAVYYCARELGFLFDYWGQGTLVTVSS

SEQ ID NO: 31037 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactgtgtcatgcactgggtccgccaggctccaggcaaggggctggagtgggtggcagttatatggtatgatggaagtaataaatactatgtagactccgtgaagggccgattcaccatctccagagacaattccaggaacacgctgtatctgcaaatgaacagcctgagagccgaggacacggctgtgtattactgtgcgagagaacggtatagcagtggcttgtacgactacggtttggacgtctggggccaagggaccacggtcaccgtctcctca

SEQ ID NO: 31038 - protein, 123 aa, Artificial Sequence
  Description of Artificial Sequence: Synthetic polypeptide
QVQLVESGGGVVQPGRSLRLSCAASGFTFSDCVMHWVRQAPGKGLEWVAVIWYDGSNKYYVDSVKGRFTISRDNSRNTLYLQMNSLRAEDTAVYYCARERYSSGLYDYGLDVWGQGTTVTVSS

SEQ ID NO: 31039 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaactattagtggtagtggtgttagaacatactacgcagactccgtgaagggccggtccaccatctccagagacaattccaagaatacgctgtttctgcaaatgaacagcctgagagccgaggacaaggccgtatattactgtgcgaaagggggagctaggagcagtggctggttccactttgactactggggccagggaaccctggtcaccgtctcctca

SEQ ID NO: 31040 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSTISGSGVRTYYADSVKGRSTISRDNSKNTLFLQMNSLRAEDKAVYYCAKGGARSSGWFHFDYWGQGTLVTVSS

SEQ ID NO: 31041 - DNA, 345 bp, Artificial Sequence; identical to SEQ ID NO: 30961
  Description of Artificial Sequence: Synthetic polynucleotide

SEQ ID NO: 31042 - protein, 115 aa, Artificial Sequence; identical to SEQ ID NO: 30962
  Description of Artificial Sequence: Synthetic polypeptide

SEQ ID NO: 31043 - DNA, 360 bp, Artificial Sequence; identical to SEQ ID NO: 30985
  Description of Artificial Sequence: Synthetic polynucleotide

SEQ ID NO: 31044 - protein, 120 aa, Artificial Sequence; identical to SEQ ID NO: 30986
  Description of Artificial Sequence: Synthetic polypeptide

SEQ ID NO: 31045 - DNA, 345 bp, Artificial Sequence
  Description of Artificial Sequence: Synthetic polynucleotide
caggtgcagctacagcagtggggcgcaggactgttgaagccttcggagcccctgtccctcacctgcgctgtctatggtgggtccttcagtgtttcctactggagctggatccgccagcccccagggaaggggctggagtggattggggaaatcaatcatagtggacgcgccaactacaacccgtccctcaagagtcgagtcaccatatcaatagacacgtccaagaaccagttctccctgaagctgagctctgtgaccgccgcggacacggctgtgtattactgtgcgagggactacggtgtccttgactactggggccagggaaccctggtcaccgtctcctca

SEQ ID NO: 31046 - protein, 115 aa, Artificial Sequence
  Description of Artificial Sequence: Synthetic polypeptide
QVQLQQWGAGLLKPSEPLSLTCAVYGGSFSVSYWSWIRQPPGKGLEWIGEINHSGRANYNPSLKSRVTISIDTSKNQFSLKLSSVTAADTAVYYCARDYGVLDYWGQGTLVTVSS

SEQ ID NO: 31047 - DNA, 360 bp, Artificial Sequence; identical to SEQ ID NO: 30985
  Description of Artificial Sequence: Synthetic polynucleotide

SEQ ID NO: 31048 - protein, 120 aa, Artificial Sequence; identical to SEQ ID NO: 30986
  Description of Artificial Sequence: Synthetic polypeptide

SEQ ID NO: 31049 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcattaactatggcatgcactgggtccgccaggctccaggcaaggggctggagtgggtggcagttatatggtatgatgaaaataataaatactatgtagactccgtgaagggccgattcaccatctccagagacgattccaagaacacgctgtatctgcaaatgaacagcctgagagccgaggactcggctgtgtattactgtgcgagagagacgggtttcttgagcgactactggggccagggaaccctggtcaccgtctcctca

SEQ ID NO: 31050 - protein, 117 aa, Artificial Sequence
  Description of Artificial Sequence: Synthetic polypeptide
QVQLVESGGGVVQPGRSLRLSCAASGFTLINYGMHWVRQAPGKGLEWVAVIWYDENNKYYVDSVKGRFTISRDDSKNTLYLQMNSLRAEDSAVYYCARETGFLSDYWGQGTLVTVSS

SEQ ID NO: 31051 - DNA, 369 bp, Artificial Sequence; identical to SEQ ID NO: 31037
  Description of Artificial Sequence: Synthetic polynucleotide

SEQ ID NO: 31052 - protein, 123 aa, Artificial Sequence; identical to SEQ ID NO: 31038
  Description of Artificial Sequence: Synthetic polypeptide

SEQ ID NO: 31053 - DNA, 345 bp, Artificial Sequence; identical to SEQ ID NO: 28135
  Description of Artificial Sequence: Synthetic polynucleotide

SEQ ID NO: 31054 - protein, 115 aa, Artificial Sequence; identical to SEQ ID NO: 28136
  Description of Artificial Sequence: Synthetic polypeptide

SEQ ID NO: 31055 - DNA, 363 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataattattatccagtatctgtgagaagtcgaataaccatcaacccagacacatccaagaaccagttctccctgctgctgaactctgtgactcccgaggacacggctgtgtattactgtgcaagagatcaacggtactacggtatggacgtctggggccaagggaccacggtcaccgtctcctca

SEQ ID NO: 31056 - protein, 121 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNYYPVSVRSRITINPDTSKNQFSLLLNSVTPEDTAVYYCARDQRYYGMDVWGQGTTVTVSS

SEQ ID NO: 31057 - DNA, 360 bp, Artificial Sequence; identical to SEQ ID NO: 30985
  Description of Artificial Sequence: Synthetic polynucleotide

SEQ ID NO: 31058 - protein, 120 aa, Artificial Sequence; identical to SEQ ID NO: 30986
  Description of Artificial Sequence: Synthetic polypeptide

SEQ ID NO: 31059 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagccatggcatgcactgggtccgccaggctccaggcaaggggctggagtgggtggcagttacatggtatgatggaagtgataaatactatgcagactccgtgaagggccgattcaccatctccagagacaattccaagaacacgctgtatctgcaaatgaacagcctgagagccgaggacacggctgtatattactgtgcgcgagaccggctagtgggagctactaccgatgcttttgatatctggggccaagggacaatggtcaccgtctcttca

SEQ ID NO: 31060 - protein, 122 aa, Artificial Sequence
  Description of Artificial Sequence: Synthetic polypeptide
QVQLVESGGGVVQPGRSLRLSCAASGFTFSSHGMHWVRQAPGKGLEWVAVTWYDGSDKYYADSVKGRFTISRDNSKNTLYLQMNSLRAEDTAVYYCARDRLVGATTDAFDIWGQGTMVTVSS

SEQ ID NO: 31061 - DNA, 369 bp, Artificial Sequence
  Description of Artificial Sequence: Synthetic polynucleotide
caggttcagctggtgcagtctggagctgaggtgacgaagcctggggcctcagtgaaggtctcctgcaaggcttctggttacacctttaccaacaatggtatcagctgggtgcgacaggcccctggacaagggcttgagtggatgggatggatcaacgcttacaatggtcacacaaactatgcacagaagttccagggcagagtcaccatgaccacagacacatccacgagcacagcctacatggagctgaggagcctgagatctgacgacacggccgtgtattactgtgcgagagatcctacggtgacccactactattactacggtatggacgtctggggccaagggaccacggtcaccgtctcctca

SEQ ID NO: 31062 - protein, 123 aa, Artificial Sequence
  Description of Artificial Sequence: Synthetic polypeptide
QVQLVQSGAEVTKPGASVKVSCKASGYTFTNNGISWVRQAPGQGLEWMGWINAYNGHTNYAQKFQGRVTMTTDTSTSTAYMELRSLRSDDTAVYYCARDPTVTHYYYYGMDVWGQGTTVTVSS

SEQ ID NO: 31063 - DNA, 360 bp, Artificial Sequence
  Description of Artificial Sequence: Synthetic polynucleotide
caggtgcagctggtggggtctgggggaggcgtggtccagcctgggaggtccctgagactctcctgtgcagcgtctggattcaccttcagtagctatggcatgcactgggtccgccaggctccaggcaaggggctggaatgggtggcagttctttggtttgatggaagtaatagaaactatgcagactccgtgaagggccgattcaccatctccagagacaattccaagaacacgctgtatctgcaaatgaacagcctgagagccgaggacacggctgtgtattactgtgcgagagatcggggagtgggctactacggtacggacgtctggggccaagggaccacggtcaccgtctcctca

SEQ ID NO: 31064 - protein, 120 aa, Artificial Sequence
  Description of Artificial Sequence: Synthetic polypeptide
QVQLVGSGGGVVQPGRSLRLSCAASGFTFSSYGMHWVRQAPGKGLEWVAVLWFDGSNRNYADSVKGRFTISRDNSKNTLYLQMNSLRAEDTAVYYCARDRGVGYYGTDVWGQGTTVTVSS

SEQ ID NO: 31065 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagtgtctggaatcaccttcagtagttatggcatgcactgggcccgccaggctccaggcaaggggctggagtgggtggcagttatatggtatgatggaagtaataaaaactatgaagactccgtgaagggccgattcaccatctccagagacaactccaagaacacgctgtatctgcaaatgaacagcctgagagccgaggacacggctgtgtattactgtgcgagagatgggagttatggttacgacggtatggacgtctggggccaagggaccacggtcaccgtctcctca

SEQ ID NO: 31066 - protein, 120 aa, Artificial Sequence
  Description of Artificial Sequence: Synthetic polypeptide
QVQLVESGGGVVQPGRSLRLSCAVSGITFSSYGMHWARQAPGKGLEWVAVIWYDGSNKNYEDSVKGRFTISRDNSKNTLYLQMNSLRAEDTAVYYCARDGSYGYDGMDVWGQGTTVTVSS

SEQ ID NO: 31067 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggcatgatggaagtaataaatactatgcagactccgtgaagggccgattcaccatctccagagacaattccaagaacacgctgtatctgcaaatgaacagcctgagagccgaggacacggctgtgtattactgtgcgaggttagactacagtaactacgggtggttcgacccctggggccagggaaccctggtcaccgtctcctca

SEQ ID NO: 31068 - protein, 120 aa, Artificial Sequence
  Description of Artificial Sequence: Synthetic polypeptide
QVQLVESGGGVVQPGRSLRLSCAASGFTFSNYGMHWVRQAPGKGLEWVAVIWHDGSNKYYADSVKGRFTISRDNSKNTLYLQMNSLRAEDTAVYYCARLDYSNYGWFDPWGQGTLVTVSS

SEQ ID NO: 31069 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaactccaagaacacgctgtatctgcaaatgaacagcctgagagccgaggacacggctgtgttttactgtgcgagagataggacggtgggctatgatggttttgatatctggggccaagggacaatggtcaccgtctcttca

SEQ ID NO: 31070 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVFYCARDRTVGYDGFDIWGQGTMVTVSS

SEQ ID NO: 31071 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatgaacactatgcagactccgtgaagggccgattcaccatctccagagacaattccaagaaaacgctgtatctgcaaatgaacagcctgagagccgaggacacggctgtgtattactgtgcgagagaccacggtgtcgggtactacggtatggacgtctggggccaagggaccacggtcaccgtctcctca

SEQ ID NO: 31072 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNEHYADSVKGRFTISRDNSKKTLYLQMNSLRAEDTAVYYCARDHGVGYYGMDVWGQGTTVTVSS

SEQ ID NO: 31073 - DNA, 369 bp, Artificial Sequence
  Description of Artificial Sequence: Synthetic polynucleotide
caggttcagctggtgcagtctggagctgaggtgaagaagcctggggcctcagtgaaggtctcctgcaaggcttctggttacacctttaccaggcatggtatcagctgggtgcgactggcccctggacaagggcttgagtggatgggatggatcagcgcttacaatggtctcacaaactatgcacagaagttccagggcagagtcaccatgaccacagacacatccacgagcacaggctacatggagctgcggagcctgagatctgacgacacggccgtgtattactgtgcgagagatcctacggtgacccactactactactacggtatggacgtctggggccaagggaccacggtcaccgtctcctca

SEQ ID NO: 31074 - protein, 123 aa, Artificial Sequence
  Description of Artificial Sequence: Synthetic polypeptide
QVQLVQSGAEVKKPGASVKVSCKASGYTFTRHGISWVRLAPGQGLEWMGWISAYNGLTNYAQKFQGRVTMTTDTSTSTGYMELRSLRSDDTAVYYCARDPTVTHYYYYGMDVWGQGTTVTVSS

SEQ ID NO: 31075 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgtagactccgtgaagggccgattcaccatctccagagacaattccaagaacacgctgtatctgcaaatgaacagcctgagagccgaggacacggctgtgtattactgtgcgagagactacggtgtcgggtactacggtacggacgtctggggccaagggaccacggtcaccgtctcctca

SEQ ID NO: 31076 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYVDSVKGRFTISRDNSKNTLYLQMNSLRAEDTAVYYCARDYGVGYYGTDVWGQGTTVTVSS

SEQ ID NO: 31077 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaattatgcagactccgtgaagggccgattcaccatctccagagacaattccaagaacacgctgtctctgcaaatgaacagcctgagagccgaggacacggctgtgtattactgtgcgagagactacggtgtcgggtactacggtacggacgtctggggccaagggaccacggtcaccgtctcctca

SEQ ID NO: 31078 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLSLQMNSLRAEDTAVYYCARDYGVGYYGTDVWGQGTTVTVSS

SEQ ID NO: 31079 - DNA, 360 bp, Artificial Sequence; identical to SEQ ID NO: 31071
  Description of Artificial Sequence: Synthetic polynucleotide

SEQ ID NO: 31080 - protein, 120 aa, Artificial Sequence; identical to SEQ ID NO: 31072
  Description of Artificial Sequence: Synthetic polypeptide

SEQ ID NO: 31081 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggaatgggtgacagctatatggtatgatggaagtcataaatactatacagattccgtgaagggccgattcaccatctccagagacaattccaagaacacgctgtatctgcaaatgaacagcctgagagccgaggacacggctgtgtattactgtgcgagagatcggagtatagtgggagctacctactttgactactggggccagggaaccctggtcaccgtctcctca

SEQ ID NO: 31082 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVTAIWYDGSHKYYTDSVKGRFTISRDNSKNTLYLQMNSLRAEDTAVYYCARDRSIVGATYFDYWGQGTLVTVSS

SEQ ID NO: 31083 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagatatggcatgcactgggtccgccaggctccaggcaaggggctggagtgggtggcagttatatggtatgatggaagtaataaacactatgcagactccgtgaagggccgattcaccatctccagagacaattccaagaatacgttgtatctgcaaatgaacagtctgagaggcgaggacacggctgtgtattactgtgcgagagatcggggagtgggctacaacggtatggacgtctggggccaagggaccacggtcaccgtctcctca

SEQ ID NO: 31084 - protein, 120 aa, Artificial Sequence
  Description of Artificial Sequence: Synthetic polypeptide
QVQLVESGGGVVQPGRSLRLSCAASGFTFSRYGMHWVRQAPGKGLEWVAVIWYDGSNKHYADSVKGRFTISRDNSKNTLYLQMNSLRGEDTAVYYCARDRGVGYNGMDVWGQGTTVTVSS

SEQ ID NO: 31085 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatgcactgggtccgccaggctccaggcaaggggctggagtgggtgacagttatatggtatgatggaagtaataaatattatgcagactccgtgaagggccgattcaccatctccagagacaattccaagaacacgctgtatctgcaaatgaacagcctgagagccgaggacacggctgtgtattactgtgcgagagaacgttatagcagtggctggtacgactacggtatggacgtctggggccaagggaccacggtcaccgtctcctca

SEQ ID NO: 31086 - protein, 123 aa, Artificial Sequence
  Description of Artificial Sequence: Synthetic polypeptide
QVQLVESGGGVVQPGRSLRLSCAASGFTFSDYVMHWVRQAPGKGLEWVTVIWYDGSNKYYADSVKGRFTISRDNSKNTLYLQMNSLRAEDTAVYYCARERYSSGWYDYGMDVWGQGTTVTVSS

SEQ ID NO: 31087 - DNA, 360 bp, Artificial Sequence; identical to SEQ ID NO: 31065
  Description of Artificial Sequence: Synthetic polynucleotide

SEQ ID NO: 31088 - protein, 120 aa, Artificial Sequence; identical to SEQ ID NO: 31066
  Description of Artificial Sequence: Synthetic polypeptide

SEQ ID NO: 31089 - DNA, 360 bp, Artificial Sequence; identical to SEQ ID NO: 31077
  Description of Artificial Sequence: Synthetic polynucleotide

SEQ ID NO: 31090 - protein, 120 aa, Artificial Sequence; identical to SEQ ID NO: 31078
  Description of Artificial Sequence: Synthetic polypeptide

SEQ ID NO: 31091 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaactccaagaacacgctgtatctgcaaatgaacagcctgagagccgaggacacggctgtgtattactgtgcgagagataggacggtgggctatgatggttttgatatctggggccaagggacaatggtcaccgtctcttca

SEQ ID NO: 31092 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDRTVGYDGFDIWGQGTMVTVSS

SEQ ID NO: 31093 - DNA, 360 bp, Artificial Sequence
  Description of Artificial Sequence: Synthetic polynucleotide
caggtgcagttggtggagtctgggggaggcgtggtccagcctgggaggtccctgagactctcctgtgcaacgtctggattcaccttcagtagctatggcatgcactgggtccgccaggctccaggcaaggggctggagtgggtggcagttatatggtatgatggaagtaataaacactatgcagactccgtgaagggccgattcaccatctccagagacaattccaagaacacgctgtatctgcaaatgaacagcctgagagccgaggacacggctgtgtattactgtgcgagagactacggtgtcgggtacgacggtatggacgtctggggccaagggaccacggtcaccgtctcctca

SEQ ID NO: 31094 - protein, 120 aa, Artificial Sequence
  Description of Artificial Sequence: Synthetic polypeptide
QVQLVESGGGVVQPGRSLRLSCATSGFTFSSYGMHWVRQAPGKGLEWVAVIWYDGSNKHYADSVKGRFTISRDNSKNTLYLQMNSLRAEDTAVYYCARDYGVGYDGMDVWGQGTTVTVSS

SEQ ID NO: 31095 - DNA, 360 bp, Artificial Sequence; identical to SEQ ID NO: 31065
  Description of Artificial Sequence: Synthetic polynucleotide

SEQ ID NO: 31096 - protein, 120 aa, Artificial Sequence; identical to SEQ ID NO: 31066
  Description of Artificial Sequence: Synthetic polypeptide

SEQ ID NO: 31097 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaacactatgcagactccgtgaagggccgattcaccatctccagagacaattccaagaacacgctgtatctgcaaatgaacagcctgagagccgaggacacggctgtgtattactgtgcgagagactacggtgtcgggtactacggtacggacgtctggggccaagggaccacggtcaccgtctcctca

SEQ ID NO: 31098 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKHYADSVKGRFTISRDNSKNTLYLQMNSLRAEDTAVYYCARDYGVGYYGTDVWGQGTTVTVSS

SEQ ID NO: 31099 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctaccatatgcactgggtgcgacaggcccctggacaagggcttgagtggatgggatggatcaatcctaagagtgatggcacaaactatgcacagaagtttcagggcagggtcaccatgaccagggacacgtccatcagcacagcctacatggagctgagcaggctgagatctgacgacacggccgtgtattactgtgcgagagaaaagcctgggagctactacaaatactggggccagggaaccctggtcaccgtctcctca

SEQ ID NO: 31100 - protein, 118 aa, Artificial Sequence
  Description of Artificial Sequence: Synthetic polypeptide
QVQLVQSGAEVKKPGASVKVSCKASGYTFTGYHMHWVRQAPGQGLEWMGWINPKSDGTNYAQKFQGRVTMTRDTSISTAYMELSRLRSDDTAVYYCAREKPGSYYKYWGQGTLVTVSS

SEQ ID NO: 31101 - DNA, 351 bp, Artificial Sequence
  Description of Artificial Sequence: Synthetic polynucleotide
caggttcagctggtgcagtctggagctgaggtgaagaagcctggggcctcagtgaaggtctcctgcaaggcttctggtttcacctttaccagctatggtatcaactgggtgcgacaggcccctggacaagggcttgagtggatgggatggatcagcgttcacaatggtaacacagactatgcacagaagttccagggcagagtcaccatgaccacagacacatccacgagcacagcctacatggaactgaggagcctgagatctgacgacacggccgtgtattactgtgcgagagactactactacggtatggacgtctggggccaagggaccaaggtcaccgtctcctca

SEQ ID NO: 31102 - protein, 117 aa, Artificial Sequence
  Description of Artificial Sequence: Synthetic polypeptide
QVQLVQSGAEVKKPGASVKVSCKASGFTFTSYGINWVRQAPGQGLEWMGWISVHNGNTDYAQKFQGRVTMTTDTSTSTAYMELRSLRSDDTAVYYCARDYYYGMDVWGQGTKVTVSS

SEQ ID NO: 31103 - DNA, 360 bp, Artificial Sequence
  Description of Artificial Sequence: Synthetic polynucleotide
caggtgcagctggtggagtctgggggaggcgtggtccagcctgggaggtccctgagactctcctgtgaagcgtctggattcaccttcagtagctatggcatgcactgggtccgccaggctccaggcaaggggctggagtgggtggcagttatatggtatgatggaagtaataaaaactatggagactccgtgaagggccgattcaccatctccagagacaattccaagaatacgctgtatctgcaaatgaacagcctgagagccgaggacacggctgtgtattactgtgcgagagatcggggagtgggctacgacggaatggacgtctggggccaagggaccacggtcaccgtctcctca

SEQ ID NO: 31104 - protein, 120 aa, Artificial Sequence
  Description of Artificial Sequence: Synthetic polypeptide
QVQLVESGGGVVQPGRSLRLSCEASGFTFSSYGMHWVRQAPGKGLEWVAVIWYDGSNKNYGDSVKGRFTISRDNSKNTLYLQMNSLRAEDTAVYYCARDRGVGYDGMDVWGQGTTVTVSS

SEQ ID NO: 31105 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatgaaaactatgcagactccgtgaagggccgaatcaccatctccagagacaattccaagaacacgctgtatctgcaaatgaacagcctgagagccgaggacacggctgtgtattactgtgcgagagataggacggtgggctatgatggttgtgatatctggggccaaggggcaatggtcaccgtctcttca

SEQ ID NO: 31106 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNENYADSVKGRITISRDNSKNTLYLQMNSLRAEDTAVYYCARDRTVGYDGCDIWGQGAMVTVSS

SEQ ID NO: 31107 - DNA, 366 bp, Artificial Sequence
  Description of Artificial Sequence: Synthetic polynucleotide
caggtccagctggtgcagtctggggctgaggtgaagaagcctggggcctcagtgaaggtctcctgcaaggcttctggatacaccttcaccggccactatatacactgggtgcgacaggcccctggacaagggcttgagtggatgggatggatcaactctaacagtggtggcacaaactatgcacagaagtttcagggcagggtcaccatgaccagggacacgtccatcagcacagcctacatggagctgagcaggctgagatctgacgacacggccgtatattactgtgcgaaagacgggagatacagctatggttacgactggttcgacccctggggccagggaaccctggtcaccgtctcctca

SEQ ID NO: 31108 - protein, 122 aa, Artificial Sequence
  Description of Artificial Sequence: Synthetic polypeptide
QVQLVQSGAEVKKPGASVKVSCKASGYTFTGHYIHWVRQAPGQGLEWMGWINSNSGGTNYAQKFQGRVTMTRDTSISTAYMELSRLRSDDTAVYYCAKDGRYSYGYDWFDPWGQGTLVTVSS

SEQ ID NO: 31109 - DNA, 360 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtctctgcaaatgaacagcctgagagccgaggacacggctgtgtattactgtgcgagagactacggtgtcgggtactacggtacggacgtctggggccaagggaccacggtcaccgtctcctca

SEQ ID NO: 31110 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLSLQMNSLRAEDTAVYYCARDYGVGYYGTDVWGQGTTVTVSS

SEQ ID NO: 31111 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgtcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtattttactgtgcgagagagaggtataccagcagctggtacgactacggtatggacgtctggggccaagggaccacggtcaccgtctcctca

SEQ ID NO: 31112 - protein, 123 aa, Artificial Sequence
  Description of Artificial Sequence: Synthetic polypeptide
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVFYCARERYTSSWYDYGMDVWGQGTTVTVSS

SEQ ID NO: 31113 - DNA, 369 bp, Artificial Sequence; identical to SEQ ID NO: 31085
  Description of Artificial Sequence: Synthetic polynucleotide

SEQ ID NO: 31114 - protein, 123 aa, Artificial Sequence; identical to SEQ ID NO: 31086
  Description of Artificial Sequence: Synthetic polypeptide

SEQ ID NO: 31115 - DNA, 369 bp, Artificial Sequence; identical to SEQ ID NO: 31085
  Description of Artificial Sequence: Synthetic polynucleotide

SEQ ID NO: 31116 - protein, 123 aa, Artificial Sequence; identical to SEQ ID NO: 31086
  Description of Artificial Sequence: Synthetic polypeptide

SEQ ID NO: 31117 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatacactgggtccgccaggctccaggcaaggggctggagtgggtgacagttatatggtatgatggaagtaataaatattatgcagactccgtgaagggccgattcaccatctccagagacaattccaagaacacgctgtatctgcaaatgaacagtgtgagagccgaggacacggctgtgtattactgtgcgagagaacgttatagcagtggctggtacgactacggtatggacgtctggggccaagggaccacggtcaccgtctcctca

SEQ ID NO: 31118 - protein, 123 aa, Artificial Sequence
  Description of Artificial Sequence: Synthetic polypeptide
QVQLVESGGGVVQPGRSLRLSCAASGFTFSDYVIHWVRQAPGKGLEWVTVIWYDGSNKYYADSVKGRFTISRDNSKNTLYLQMNSVRAEDTAVYYCARERYSSGWYDYGMDVWGQGTTVTVSS

SEQ ID NO: 31119 - DNA, 360 bp, Artificial Sequence; identical to SEQ ID NO: 31077
  Description of Artificial Sequence: Synthetic polynucleotide

SEQ ID NO: 31120 - protein, 120 aa, Artificial Sequence; identical to SEQ ID NO: 31078
  Description of Artificial Sequence: Synthetic polypeptide

SEQ ID NO: 31121 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagattccgtgaagggccgattcaccatctccagagacaattccaagaacacactgtatctgcaaatgaacagcctgagagccgaggacacggctgtgtattactgtgcgagagactgcggtgtcggatactacggtacggacgtctggggccaagggaccacggtcaccgtctcctca

SEQ ID NO: 31122 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDCGVGYYGTDVWGQGTTVTVSS

SEQ ID NO: 31123 - DNA, 366 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggccactatatacactgggtgcgacaggcccctggacaagggcttgagtggatgggatggatcaactctaacagtggtggcacaaattatgcagagaagtttcagggcagggtcaccatgaccagggacacgtccatcagcacagcctacatggagctgagcaggctgagatctgacgacacggccgtgtattactgtgcgaaagacgggagatacagctatggtcacgactggttcgacccctggggccagggaaccctggtcaccgtctcctca

SEQ ID NO: 31124 - protein, 122 aa, Artificial Sequence
  Description of Artificial Sequence: Synthetic polypeptide
QVQLVQSGAEVKKPGASVKVSCKASGYTFTGHYIHWVRQAPGQGLEWMGWINSNSGGTNYAEKFQGRVTMTRDTSISTAYMELSRLRSDDTAVYYCAKDGRYSYGHDWFDPWGQGTLVTVSS

SEQ ID NO: 31125 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagttactatggcatgcactgggtccgccaggctccaggcaaggggctggagtgggtggcagttatatggcatgatggaagtaataaatactatgcagactccgtgaagggccgattcaccatctccagagacaattccaagaacacgctgtatctgcaaatgaacagcctgagagccgaggacacggctgtgtattactgtgcgaggttagactacagtaattacgggtggttcgacccctggggccagggaaccctggtcaccgtctcctca

SEQ ID NO: 31126 - protein, 120 aa, Artificial Sequence
  Description of Artificial Sequence: Synthetic polypeptide
QVQLVESGGGVVQPGRSLRLSCAASGFTFSYYGMHWVRQAPGKGLEWVAVIWHDGSNKYYADSVKGRFTISRDNSKNTLYLQMNSLRAEDTAVYYCARLDYSNYGWFDPWGQGTLVTVSS

SEQ ID NO: 31127 - DNA, 369 bp, Artificial Sequence; identical to SEQ ID NO: 31085
  Description of Artificial Sequence: Synthetic polynucleotide

SEQ ID NO: 31128 - protein, 123 aa, Artificial Sequence; identical to SEQ ID NO: 31086
  Description of Artificial Sequence: Synthetic polypeptide

SEQ ID NO: 31129 - DNA, 360 bp, Artificial Sequence
  Description of Artificial Sequence: Synthetic polynucleotide
caggtgcaactggtggagtctgggggaggcgtggtccagcctgggaggtccctgagactctcctgtgcagcgtctggactcaccttcagtagctatggcatgcactgggtccgccaggctccaggcaaggggctggagtgggtggcagttatatggtatgatggaagtaatgaacactatgcagactccgtgaagggccgattcaccatctccagagacaattccaagaacacgctgtatctgcaaatgaacagcctgagagccgaggacacggctgtgtattactgtgcgagagatcggggagtgggctactacggtatggacgtctggggccaagggaccacggtcaccgtctcctca

SEQ ID NO: 31130 - protein, 120 aa, Artificial Sequence
  Description of Artificial Sequence: Synthetic polypeptide
QVQLVESGGGVVQPGRSLRLSCAASGLTFSSYGMHWVRQAPGKGLEWVAVIWYDGSNEHYADSVKGRFTISRDNSKNTLYLQMNSLRAEDTAVYYCARDRGVGYYGMDVWGQGTTVTVSS

SEQ ID NO: 31131 - DNA, 360 bp, Artificial Sequence; identical to SEQ ID NO: 31067
  Description of Artificial Sequence: Synthetic polynucleotide

SEQ ID NO: 31132 - protein, 120 aa, Artificial Sequence; identical to SEQ ID NO: 31068
  Description of Artificial Sequence: Synthetic polypeptide

SEQ ID NO: 31133 - DNA, 363 bp, Artificial Sequence
  Description of Artificial Sequence: Synthetic polynucleotide
caggtgcagctggtggagtcggggggaggcgtggtccagcctgggaggtccctgagactctcctgtgcagcgtctggattcaccttcagtagctatggcatgcactgggtccgccaggctccaggcaaggggctggagtgggtggcagctatatggtatgatggaagtaataaatactatgcagactccgtgaagggccgattcaccatctccagagacaattccaagcgcacgctgtatctgcagatgaacagcctgagagccgaggacacggctgtgtattactgtgcgagagatcccaacatagtgggagctacttggtttgactactggggccagggaaccctggtcaccgtctcctca

SEQ ID NO: 31134 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAAIWYDGSNKYYADSVKGRFTISRDNSKRTLYLQMNSLRAEDTAVYYCARDPNIVGATWFDYWGQGTLVTVSS

SEQ ID NO: 31135 - DNA, 351 bp, Artificial Sequence
  Description of Artificial Sequence: Synthetic polynucleotide
gaggtacagctggtggagtctgggggaggcttggtacagcctggggggtccctgagactctcctgtgcagcctctggattctccttcagaagctatagcatgaactgggtccgccaggctccagggaaggggctggagtgggtttcatacattactggtagtagtagtaccatatactacgcagactctgtgaagggccgattcaccatctccagagacaatgccaagaactcactgtatctgcaaatgaacagcctgagagacgaggacacggctgtgtattactgtgcgagatcgggtttagcagtggaggactactggggccagggaaccctggtcaccgtctcctca

SEQ ID NO: 31136 - protein, 117 aa, Artificial Sequence
  Description of Artificial Sequence: Synthetic polypeptide
EVQLVESGGGLVQPGGSLRLSCAASGFSFRSYSMNWVRQAPGKGLEWVSYITGSSSTIYYADSVKGRFTISRDNAKNSLYLQMNSLRDEDTAVYYCARSGLAVEDYWGQGTLVTVSS

SEQ ID NO: 31137 - DNA, 369 bp, Artificial Sequence; identical to SEQ ID NO: 31085
  Description of Artificial Sequence: Synthetic polynucleotide

SEQ ID NO: 31138 - protein, 123 aa, Artificial Sequence; identical to SEQ ID NO: 31086
  Description of Artificial Sequence: Synthetic polypeptide

SEQ ID NO: 31139 - DNA, 369 bp, Artificial Sequence; identical to SEQ ID NO: 31085
  Description of Artificial Sequence: Synthetic polynucleotide

SEQ ID NO: 31140 - protein, 123 aa, Artificial Sequence; identical to SEQ ID NO: 31086
  Description of Artificial Sequence: Synthetic polypeptide

SEQ ID NO: 31141 - DNA, 369 bp, Artificial Sequence
  Description of Artificial Sequence: Synthetic polynucleotide
gaggtgcaactggtggagtcggggggaggcttggtacagcctggggggtccctgagactctcctgtgcagcctctggattcaccttcagtagctataatatgaactgggtccgccaggctccagggaagggcctggagtgggtttcatacattagtagtagtcgtaatatcatatattacgcagactctgtgaagggccgattcaccatctccagagaaaatgccaagaactcactgtctctgcaaatggacagcctgagagacgaggacacggctgtgtattactgtgcgcgagatggctcttatagcagtggctggtactggggttttgactactggggccagggcaccctggtcaccgtctcctca

SEQ ID NO: 31142 - protein, 123 aa, Artificial Sequence
  Description of Artificial Sequence: Synthetic polypeptide
EVQLVESGGGLVQPGGSLRLSCAASGFTFSSYNMNWVRQAPGKGLEWVSYISSSRNIIYYADSVKGRFTISRENAKNSLSLQMDSLRDEDTAVYYCARDGSYSSGWYWGFDYWGQGTLVTVSS

SEQ ID NO: 31143 - DNA, 369 bp, Artificial Sequence; identical to SEQ ID NO: 31085
  Description of Artificial Sequence: Synthetic polynucleotide

SEQ ID NO: 31144 - protein, 123 aa, Artificial Sequence; identical to SEQ ID NO: 31086
  Description of Artificial Sequence: Synthetic polypeptide

SEQ ID NO: 31145 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagcaatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagactacggtgtcgggtactacggtctggacgtctggggccaagggaccacggtcaccgtctcctca

SEQ ID NO: 31146 - protein, 120 aa, Artificial Sequence
  Description of Artificial Sequence: Synthetic polypeptide
QVQLVESGGGVVQPGRSLRLSCAASGFTFSSNGMHWVRQAPGKGLEWVAVIWYDGSNKNYADSVKGRFTISRDNSKNTLYLQMNSLRAEDTAVYYCARDYGVGYYGLDVWGQGTTVTVSS

SEQ ID NO: 31147 - DNA, 360 bp, Artificial Sequence; identical to SEQ ID NO: 31065
  Description of Artificial Sequence: Synthetic polynucleotide

SEQ ID NO: 31148 - protein, 120 aa, Artificial Sequence; identical to SEQ ID NO: 31066
  Description of Artificial Sequence: Synthetic polypeptide

SEQ ID NO: 31149 - DNA, 369 bp, Artificial Sequence; identical to SEQ ID NO: 31085
  Description of Artificial Sequence: Synthetic polynucleotide

SEQ ID NO: 31150 - protein, 123 aa, Artificial Sequence; identical to SEQ ID NO: 31086
  Description of Artificial Sequence: Synthetic polypeptide

SEQ ID NO: 31151 - DNA, 369 bp, Artificial Sequence; identical to SEQ ID NO: 31085
  Description of Artificial Sequence: Synthetic polynucleotide

SEQ ID NO: 31152 - protein, 123 aa, Artificial Sequence; identical to SEQ ID NO: 31086
  Description of Artificial Sequence: Synthetic polypeptide

SEQ ID NO: 31153 - DNA, 369 bp, Artificial Sequence; identical to SEQ ID NO: 31085
  Description of Artificial Sequence: Synthetic polynucleotide

SEQ ID NO: 31154 - protein, 123 aa, Artificial Sequence; identical to SEQ ID NO: 31086
  Description of Artificial Sequence: Synthetic polypeptide

SEQ ID NO: 31155 - DNA, 360 bp, Artificial Sequence; identical to SEQ ID NO: 31083
  Description of Artificial Sequence: Synthetic polynucleotide

SEQ ID NO: 31156 - protein, 120 aa, Artificial Sequence; identical to SEQ ID NO: 31084
  Description of Artificial Sequence: Synthetic polypeptide

SEQ ID NO: 31157 - DNA, 378 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtacttactactggagctggatccggcagcccccagggaagggactggagtggattgggtatatctattacagtgggaccaccaactacaacccctccctcaagagtcgagtcaccatatcagtagacacgtccaagaaccagttctccctgaagctgagctctgtgaccgctgcggacacggccgtgtattactgtgcgagagaccagcagtggctggtacgtgggagggacaactactactacggtatggacgtctggggccaagggaccacggtcaccgtctcctca

SEQ ID NO: 31158 - protein, 126 aa, Artificial Sequence
  Description of Artificial Sequence: Synthetic polypeptide
QVQLQESGPGLVKPSETLSLTCTVSGGSISTYYWSWIRQPPGKGLEWIGYIYYSGTTNYNPSLKSRVTISVDTSKNQFSLKLSSVTAADTAVYYCARDQQWLVRGRDNYYYGMDVWGQGTTVTVSS

SEQ ID NO: 31159 - DNA, 369 bp, Artificial Sequence; identical to SEQ ID NO: 31085
  Description of Artificial Sequence: Synthetic polynucleotide

SEQ ID NO: 31160 - protein, 123 aa, Artificial Sequence; identical to SEQ ID NO: 31086
  Description of Artificial Sequence: Synthetic polypeptide

SEQ ID NO: 31161 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaagacttctggatacaccttcaccggctactatatgcactgggtgcgacaggcccctggacaagggcttgagtggatgggatggatccaccctaacagtggtggcacaaactatgcacagaaatttcagggcagggtcaccctgaccagggacacgtccatcagcacagcctacatggacctgagcaggctgagatctgacgacacggccgtgtattactgtgcgagagatgggaccagctcgtttgactactggggccagggaaccctggtcaccgtctcctca

SEQ ID NO: 31162 - protein, 117 aa, Artificial Sequence
  Description of Artificial Sequence: Synthetic polypeptide
QVQLVQSGAEVKKPGASVKVSCKTSGYTFTGYYMHWVRQAPGQGLEWMGWIHPNSGGTNYAQKFQGRVTLTRDTSISTAYMDLSRLRSDDTAVYYCARDGTSSFDYWGQGTLVTVSS

SEQ ID NO: 31163 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagcaatggcatgcactgggtccgccaggctccaggcaaggggctggagtgggtggcagttatatggtacgatggaagtaatgaaaactatgcagactccgtgaagggccgattcaccatctccagagacaattccaagaacacgctgtatctgcaaatgaacagcctgagagccgaggacacggctgtgtattactgtgcgagagatcggacagtgggctacaacggtatggacgtctggggccaagggaccacggtcaccgtctcctca

SEQ ID NO: 31164 - protein, 120 aa, Artificial Sequence
  Description of Artificial Sequence: Synthetic polypeptide
QVQLVESGGGVVQPGRSLRLSCAASGFTFSSNGMHWVRQAPGKGLEWVAVIWYDGSNENYADSVKGRFTISRDNSKNTLYLQMNSLRAEDTAVYYCARDRTVGYNGMDVWGQGTTVTVSS

SEQ ID NO: 31165 - DNA, 351 bp, Artificial Sequence; identical to SEQ ID NO: 31161
  Description of Artificial Sequence: Synthetic polynucleotide

SEQ ID NO: 31166 - protein, 117 aa, Artificial Sequence; identical to SEQ ID NO: 31162
  Description of Artificial Sequence: Synthetic polypeptide

SEQ ID NO: 31167 - DNA, 351 bp, Artificial Sequence; identical to SEQ ID NO: 31161
  Description of Artificial Sequence: Synthetic polynucleotide

SEQ ID NO: 31168 - protein, 117 aa, Artificial Sequence; identical to SEQ ID NO: 31162
  Description of Artificial Sequence: Synthetic polypeptide

SEQ ID NO: 31169 - DNA, 351 bp, Artificial Sequence
  Description of Artificial Sequence: Synthetic polynucleotide
caggttcagctggtgcagtctggagctgaggtgaagaagcctggggcctcagtgaaggtctcctgcaaggcttctggtttcacctttaccagctatggtatcaactgggtgcgacaggcccctggacaagggcttgagtggatgggatggatcagcgtttacaatggtaacacaaactatgcacagaagctccagggcagagtcaccatgaccacagacacatccacgagcacagcctacatggagctgaggagcctgagatctgacgacacggccgtgtattactgtgcgagagactactactacggttttgacgtctggggccaagggaccacggtcaccgtctcctca

SEQ ID NO: 31170 - protein, 117 aa, Artificial Sequence
  Description of Artificial Sequence: Synthetic polypeptide
QVQLVQSGAEVKKPGASVKVSCKASGFTFTSYGINWVRQAPGQGLEWMGWISVYNGNTNYAQKLQGRVTMTTDTSTSTAYMELRSLRSDDTAVYYCARDYYYGFDVWGQGTTVTVSS

SEQ ID NO: 31171 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggaatgggtggcagttatatggtatgatggaagtaataaaaactatgcagactccgtgaagggccgattcaccatctccagagacaattccaagaacacgctgtatctgcaaatgaacagcctgagagccgaggacacggctgtatattactgtgcgagagatcgggatgtcgggtacaacggtatggacgtctggggccaagggaccacggtcaccgtctcctca

SEQ ID NO: 31172 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDRDVGYNGMDVWGQGTTVTVSS

SEQ ID NO: 31173 - DNA, 366 bp, Artificial Sequence
  Description of Artificial Sequence: Synthetic polynucleotide
gaggtgcagctattggagtctgggggaggcttggtacagcctggggggtccctgagactctcctgtgcagcctctggcttcacctttagcaactttgccatgagttgggtccgccaggctccagggaagggactggagtgggtctcaagtattgttggtagtggtggtcgcacgtactacgcagactccgtgaagggccggttcaccatctccagagacaattccaagaacacgctgtatctgcaaatgaacagcctgagagccgaggacacggccgtatattattgtgcgaaagacccttatcgtgtagcagtggctggggcctttgactactggggccagggaaccctgatcaccgtctcctca

SEQ ID NO: 31174 - protein, 122 aa, Artificial Sequence
  Description of Artificial Sequence: Synthetic polypeptide
EVQLLESGGGLVQPGGSLRLSCAASGFTFSNFAMSWVRQAPGKGLEWVSSIVGSGGRTYYADSVKGRFTISRDNSKNTLYLQMNSLRAEDTAVYYCAKDPYRVAVAGAFDYWGQGTLITVSS

SEQ ID NO: 31175 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggtcgctactggagctggatccgccagcccccagggaaggggctggagtggattggggaaatcaatcatagtggaagcgccaactacaacccgtccctcaagagtcgagtcaccatatcagtagacacgtccaagaaccagttctccctgaagctgagttctgtgaccgccgcggacacggctgtatattactgtgcgagagactacggcgcccttgatttctggggccaagggacaatggtcaccgtctcttca

SEQ ID NO: 31176 - protein, 115 aa, Artificial Sequence
  Description of Artificial Sequence: Synthetic polypeptide
QVQLQQWGAGLLKPSETLSLTCAVYGGSFSGRYWSWIRQPPGKGLEWIGEINHSGSANYNPSLKSRVTISVDTSKNQFSLKLSSVTAADTAVYYCARDYGALDFWGQGTMVTVSS

SEQ ID NO: 31177 - DNA, 351 bp, Artificial Sequence; identical to SEQ ID NO: 31161
  Description of Artificial Sequence: Synthetic polynucleotide

SEQ ID NO: 31178 - protein, 117 aa, Artificial Sequence; identical to SEQ ID NO: 31162
  Description of Artificial Sequence: Synthetic polypeptide

SEQ ID NO: 31179 - DNA, 366 bp, Artificial Sequence; identical to SEQ ID NO: 31173
  Description of Artificial Sequence: Synthetic polynucleotide

SEQ ID NO: 31180 - protein, 122 aa, Artificial Sequence; identical to SEQ ID NO: 31174
  Description of Artificial Sequence: Synthetic polypeptide

SEQ ID NO: 31181 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagacaattccaagaacacgctgtatctgcaaatgaacagcctgagagccgaggacacggctgtgtattactgtgcgagagatcgggatgtcgggtacaacggtatggacgtctggggccaagggaccacggtcaccgtctcctca

SEQ ID NO: 31182 - protein, 120 aa, Artificial Sequence; identical to SEQ ID NO: 31172
  Description of Artificial Sequence: Synthetic polypeptide

SEQ ID NO: 31183 - DNA, 351 bp, Artificial Sequence; identical to SEQ ID NO: 31161
  Description of Artificial Sequence: Synthetic polynucleotide

SEQ ID NO: 31184 - protein, 117 aa, Artificial Sequence; identical to SEQ ID NO: 31162
  Description of Artificial Sequence: Synthetic polypeptide

SEQ ID NO: 31185 - DNA, 351 bp, Artificial Sequence
  Description of Artificial Sequence: Synthetic polynucleotide
caggttcagctggtgcagtctggagctgaggtgaagaagcctggggcctcagtgaaggtctcctgcaaggcttctggtttcacctttaccagctatggtatcaactgggtgcgacaggcccctggacaaggacttgagtggatgggatggatcagcgtttacagtggtaacacaaactatgcacagaagctccagggcagagtcaccatgaccacagatacatccacgagcacagcctacatggagctgaggagcctgagatctgacgacacggccgtgtattactgtgcgagagactactactacggtatggacgtctggggccaagggaccacggtcaccgtctcctca

SEQ ID NO: 31186 - protein, 117 aa, Artificial Sequence
  Description of Artificial Sequence: Synthetic polypeptide
QVQLVQSGAEVKKPGASVKVSCKASGFTFTSYGINWVRQAPGQGLEWMGWISVYSGNTNYAQKLQGRVTMTTDTSTSTAYMELRSLRSDDTAVYYCARDYYYGMDVWGQGTTVTVSS

SEQ ID NO: 31187 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaaaactatgcagactccgtgaagggccgattcaccatctccagagaccattccaagaacacgctgtatctgcaaatgaacagcctgagagccgaggacacggctgtgtattactgtgcgagagatcgggatgtcgggtacaacggtatggacgtctggggccaagggaccacggtcaccgtctcctca

SEQ ID NO: 31188 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKNYADSVKGRFTISRDHSKNTLYLQMNSLRAEDTAVYYCARDRDVGYNGMDVWGQGTTVTVSS

SEQ ID NO: 31189 - DNA, 369 bp, Artificial Sequence
  Description of Artificial Sequence: Synthetic polynucleotide
gaggtgcaggtgttggagtctgggggaggcttggtacagcctggggggtccctgagactctcctgtgcagcctctggattcacctttagcagctatgccatgagctgggtccgccaggctccagggaaggggctggagtgggtctcagctattagtggcagaggcggcagcacatactacgcagacgccgtgaagggccggttcaccatctccagagacaattccaagaacacgctgtatctgcaaatgaacagcctgagagccgaggacacggccgtatattactgcgcgaaaggctcctacgatagtagtggttattaccactacttagaccactggggccagggaaccctggtcaccgtctcctca

SEQ ID NO: 31190 - protein, 123 aa, Artificial Sequence
  Description of Artificial Sequence: Synthetic polypeptide
EVQVLESGGGLVQPGGSLRLSCAASGFTFSSYAMSWVRQAPGKGLEWVSAISGRGGSTYYADAVKGRFTISRDNSKNTLYLQMNSLRAEDTAVYYCAKGSYDSSGYYHYLDHWGQGTLVTVSS

SEQ ID NO: 31191 - DNA, 363 bp, Artificial Sequence
  Description of Artificial Sequence: Synthetic polynucleotide
gaggtgcaggtgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtaacacatactacgcagactccgtgaagggccggttcaccatctccagagacaattccaagaacacgctgtatctgcacatgaacagcctgagagccgaggacacggccgtatattactgtgcgggagaggggggctactactattactacggtgtggacgtctggggccaagggaccacggtcaccgtctcctca

SEQ ID NO: 31192 - protein, 121 aa, Artificial Sequence
  Description of Artificial Sequence: Synthetic polypeptide
EVQVLESGGGLVQPGGSLRLSCAASGFTFSSYAMSWVRQAPGKGLEWVSAISGSGGNTYYADSVKGRFTISRDNSKNTLYLHMNSLRAEDTAVYYCAGEGGYYYYYGVDVWGQGTTVTVSS

SEQ ID NO: 31193 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatatcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtatagcagcaactggtacgactacggtatggacgtctggggccaagggaccacggtcaccgtctcctca

SEQ ID NO: 31194 - protein, 123 aa, Artificial Sequence
  Description of Artificial Sequence: Synthetic polypeptide
QVQLVESGGGVVQPGRSLRLSCAASGFTFSSYIMHWVRQAPGKGLEWVAVIWYDGSNKYYADSVKGRFTISRDNSKNTLYLQMNSLRAEDTAVYYCARERYSSNWYDYGMDVWGQGTTVTVSS

SEQ ID NO: 31195 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactatgcacagaagtttcagggcagagtcaccatgaccagggacacgtccatcagcacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31196 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTNYAQKFQGRVTMTRDTSISTAYMELSRLRFDDTAVFYCARDWGGYSSYYYGMDVWGQGTTVTVSS

SEQ ID NO: 31197 - DNA, 357 bp, Artificial Sequence
  Description of Artificial Sequence: Synthetic polynucleotide
cagctgcagctgcaggagtcgggcccaggactggtgaagtcttcggagaccctgtccctcacctgcactgtctctggcggctccatcagcagaagtagttactactggggctggatccgccagcccccagggaagggcctggagtggattgggaatatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagggtcgggactggggtgttgactacgggggccagggaaccctagtcaccgtctcctca

SEQ ID NO: 31198 - protein, 119 aa, Artificial Sequence
  Description of Artificial Sequence: Synthetic polypeptide
QLQLQESGPGLVKSSETLSLTCTVSGGSISRSSYYWGWIRQPPGKGLEWIGNIYYSGSTYYNPSLKSRVTISVDTSKNQFSLKLSSVTAADTAVYYCARQGRDWGVDYGGQGTLVTVSS

SEQ ID NO: 31199 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcagcttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtatagcagcagctggtacgactacggtatggacgtctggggccaagggaccacggtcaccgtctcctca

SEQ ID NO: 31200 - protein, 123 aa, Artificial Sequence
  Description of Artificial Sequence: Synthetic polypeptide
QVQLVESGGGVVQPGRSLRLSCAASGFSFSSYGMHWVRQAPGKGLEWVAVIWYDGSNKYYADSVKGRFTISRDNSKNTLYLQMNSLRAEDTAVYYCARERYSSSWYDYGMDVWGQGTTVTVSS

SEQ ID NO: 31201 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagttccagtggctggaactggttcgacccctggggccagggaaccctggtcaccgtctcctca

SEQ ID NO: 31202 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCASSSGWNWFDPWGQGTLVTVSS

SEQ ID NO: 31203 - DNA, 363 bp, Artificial Sequence
  Description of Artificial Sequence: Synthetic polynucleotide
gaggtgcaggtgttggagtctgggggaggcttggtacagcctggggggtccctgagactctcctgtgcagcctctggatccacctttagcagcgatgccatgagctgggtccgccaggctccagggaaggggctggagtgggtctcagctattagtggtagtggtgataacacattctacgcagactccgtgaagggccggttcaccatctccagagacaattccaagaacacgctgtatctgcaaatgaacagcctgagagccgaggacacggccgtatattactgtgcgaaagtctatagtgcctacgattctcactggttcgacccctggggccagggaaccctggtcaccgtctcctca

SEQ ID NO: 31204 - protein, 121 aa, Artificial Sequence
  Description of Artificial Sequence: Synthetic polypeptide
EVQVLESGGGLVQPGGSLRLSCAASGSTFSSDAMSWVRQAPGKGLEWVSAISGSGDNTFYADSVKGRFTISRDNSKNTLYLQMNSLRAEDTAVYYCAKVYSAYDSHWFDPWGQGTLVTVSS

SEQ ID NO: 31205 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactatgcacagaagtttcagggcagggtcaccatgaccagggacacgtccatcaccacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31206 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTNYAQKFQGRVTMTRDTSITTAYMELSRLRFDDTAVFYCARDWGGYSSYYYGMDVWGQGTTVTVSS

SEQ ID NO: 31207 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggttgtaccctaacagtggtaacacaggctatgcacagaagttccagggcagagtcaccatgaccaggaacacctccataagcacagcctacatggagctgagcagcctgagatctgaggacacggccgtgtattactgtgcttatagcagtggctggtactactttgactactggggccagggaaccctggtcatcgtctcctca

SEQ ID NO: 31208 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWLYPNSGNTGYAQKFQGRVTMTRNTSISTAYMELSSLRSEDTAVYYCAYSSGWYYFDYWGQGTLVIVSS

SEQ ID NO: 31209 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatccaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcctatagcagtggctggtacaagtttgactactggggccagggaaccctggtcaccgtctcctca

SEQ ID NO: 31210 - protein, 118 aa, Artificial Sequence
  Description of Artificial Sequence: Synthetic polypeptide
QVQLVQSGAEVKKPGASVKVSCKASGSTFTNYDINWVRQATGQGLEWMGWMHPNSGNTGYAQKFQGRVTMTRNTSISTAYMELSSLRSEDTAVYYCAYSSGWYKFDYWGQGTLVTVSS

SEQ ID NO: 31211 - DNA, 351 bp, Artificial Sequence
  Description of Artificial Sequence: Synthetic polynucleotide
caggtgcagctggtggagtctgggggaggcctggtccagcctggaaagtccctgagactctcctgtgcagcgtctggattcaccttcagtagctatggcatgcactgggtccgccaggctccaggcaaggggctggagtgggtggcagttatatggtatgagggaagtaataaatactatgtagactccgtgaggggccgattcaccatctccagagacaattccaagagtacgctgtatctgcaaatgaacagcctgcgagccgaggacacggctgtgtattactgtgtgagagagctaggcttccagtctgactactggggccagggaaccccggtcaccgtctcctca

SEQ ID NO: 31212 - protein, 117 aa, Artificial Sequence
  Description of Artificial Sequence: Synthetic polypeptide
QVQLVESGGGLVQPGKSLRLSCAASGFTFSSYGMHWVRQAPGKGLEWVAVIWYEGSNKYYVDSVRGRFTISRDNSKSTLYLQMNSLRAEDTAVYYCVRELGFQSDYWGQGTPVTVSS

SEQ ID NO: 31213 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactatgcacagaagtttcagggcagggtcaccatgaccagggacacgtccatcagcacagcctacatggaactgaggaggctgagatttgacgacacggccgtgttttactgtgcgagagattggggtggctacagttcttactacttcggtatggacgtctggggccaagggaccacggtcaccgtctcttca

SEQ ID NO: 31214 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTNYAQKFQGRVTMTRDTSISTAYMELRRLRFDDTAVFYCARDWGGYSSYYFGMDVWGQGTTVTVSS

SEQ ID NO: 31215 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcctatagcagtggctggtacaagtttgactactggggccagggaaccctggtcaccgtctcctca

SEQ ID NO: 31216 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNTGYAQKFQGRVTMTRNTSISTAYMELSSLRSEDTAVYYCAYSSGWYKFDYWGQGTLVTVSS

SEQ ID NO: 31217 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacagacccctggacaagggcttgagtggatgggatggatcaacccttacagtggtgacacaaactatgcacagaagtttcagggcagggtcaccatgaccagggacacgtccatcagcacagcctacatggaactgcgcaggctgagatttgacgacacggccgtcttttactgtgcgagagattggggtggctacagttcttactactacggtatggacgtctggggccaagggaccacggtcaccgtctcttca

SEQ ID NO: 31218 - protein, 123 aa, Artificial Sequence
  Description of Artificial Sequence: Synthetic polypeptide
QVQLVQSGAEVKKPGASVKVSCKASGYTFTGYYIHWVRQTPGQGLEWMGWINPYSGDTNYAQKFQGRVTMTRDTSISTAYMELRRLRFDDTAVFYCARDWGGYSSYYYGMDVWGQGTTVTVSS

SEQ ID NO: 31219 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatgtcatccactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtatagcagtggctggtacgactacggtatggacgtctggggccaagggaccacggtcaccgtctcctca

SEQ ID NO: 31220 - protein, 123 aa, Artificial Sequence
  Description of Artificial Sequence: Synthetic polypeptide
QVQLVESGGGVVQPGRSLRLSCAASGFTFSDYVIHWVRQAPGKGLEWVAVIWYDGSNKYYADSVKGRFTISRDNSKNTLYLQMNSLRAEDTAVYYCARERYSSGWYDYGMDVWGQGTTVTVSS

SEQ ID NO: 31221 - DNA, 372 bp, Artificial Sequence
  Description of Artificial Sequence: Synthetic polynucleotide
caggtgcaactggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgcggacacggccgtgtattactgtgcgagggatttagcagctcgttcttactactactacttcggtatggacgtctggggccaaggggccacggtcaccgtctcctca

SEQ ID NO: 31222 - protein, 124 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSADTAVYYCARDLAARSYYYYFGMDVWGQGATVTVSS

SEQ ID NO: 31223 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtagcacaggctatgcacagaagttccagggcagactcaccatgaccaggaacacctccataagcacagtctacatggaactgaacagcctgagatctgaggacacggccgtgtattattgtgcgagtagcagtggctggtactggttcgacccctggggccagggaaccctggtcaccgtctcctca

SEQ ID NO: 31224 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGSTGYAQKFQGRLTMTRNTSISTVYMELNSLRSEDTAVYYCASSSGWYWFDPWGQGTLVTVSS

SEQ ID NO: 31225 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactatgcacagaagtttcagggcagggtcaccatgaccagggacacgtccatcagcacagcctacatggaactgcgcaggctgagatttgacgacacggccgtcttttactgtgcgagagattggggtggctacagttcttactactacggtatggacgtctggggccaagggaccacggtcaccgtctcttca

SEQ ID NO: 31226 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTNYAQKFQGRVTMTRDTSISTAYMELRRLRFDDTAVFYCARDWGGYSSYYYGMDVWGQGTTVTVSS

SEQ ID NO: 31227 - DNA, 354 bp, Artificial Sequence
  Description of Artificial Sequence: Synthetic polynucleotide
caggtgcagctggtgcagtctggggctgaggtgaagaagcctagggcctcagtgaaggtctcctgcaaggcttctggacacaccttcaccaattatgatatcaactgggtgcgacaggccactggacaagggcttgagtggatgggatggatgcatcctaacagtggtaacacaggctttgcacagaagttccagggcagagtcaccatgaccaggaacacctccataagcacagcctacatggagctgagcagcctgagatctgaggacacggccgtgtattactgtgcatatagcagtggctggtaccgctttgactactggggccagggaaccctggtcaccgtctcctca

SEQ ID NO: 31228 - protein, 118 aa, Artificial Sequence
  Description of Artificial Sequence: Synthetic polypeptide
QVQLVQSGAEVKKPRASVKVSCKASGHTFTNYDINWVRQATGQGLEWMGWMHPNSGNTGFAQKFQGRVTMTRNTSISTAYMELSSLRSEDTAVYYCAYSSGWYRFDYWGQGTLVTVSS

SEQ ID NO: 31229 - DNA, 351 bp, Artificial Sequence
  Description of Artificial Sequence: Synthetic polynucleotide
caggtgcggctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatgaaaataataaatactatgcagactccgtgaagggccgattcaccatctccagagacaattccaagaacacgctgtatctgcaaatgaacagcctgagagccgaggacacggctgtgtattactgtgcgagagaagtgggattcactgaggactactggggccagggaaccctggtcaccgtctcctca

SEQ ID NO: 31230 - protein, 117 aa, Artificial Sequence
  Description of Artificial Sequence: Synthetic polypeptide
QVRLVESGGGVVQPGRSLRLSCAASGFTFSDYGMHWVRQAPGKGLEWVAVIWYDENNKYYADSVKGRFTISRDNSKNTLYLQMNSLRAEDTAVYYCAREVGFTEDYWGQGTLVTVSS

SEQ ID NO: 31231 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatgaaaataataaatactatgcagactccgtgaagggccgattcaccatctccagagacaattcccagaacacgctgtatctgcaaatgaccagcctgagagccgaggacacggctgtgtattactgtgcgagagaagtgggattcactgaggactactggggccagggaaccctggtcaccgtctcctca

SEQ ID NO: 31232 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYDENNKYYADSVKGRFTISRDNSQNTLYLQMTSLRAEDTAVYYCAREVGFTEDYWGQGTLVTVSS

SEQ ID NO: 31233 - DNA, 366 bp, Artificial Sequence
  Description of Artificial Sequence: Synthetic polynucleotide
caggtgcagctgcaggagtcgggcccaggactggtgaagccttcacagaccctgtccctcacctgcactgtctctggtaactccatcagcagtggtcattactactggagctggatccgccagcacccagggaagggccttgagtggattgggttcatctattacactgggagcacctactacaacccgtccctcaagagtcgagttaccatatcagtagacacgtctaagaaccagttctccctgaagctgagctctgtgactgccgcggacacggccgtgtattactgtgcgagagaggccggtgactacggctactacggtatggacgtctggggccaagggaccacggtcaccgtctcctca

SEQ ID NO: 31234 - protein, 122 aa, Artificial Sequence
  Description of Artificial Sequence: Synthetic polypeptide
QVQLQESGPGLVKPSQTLSLTCTVSGNSISSGHYYWSWIRQHPGKGLEWIGFIYYTGSTYYNPSLKSRVTISVDTSKNQFSLKLSSVTAADTAVYYCAREAGDYGYYGMDVWGQGTTVTVSS

SEQ ID NO: 31235 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatgaaaataataaatactatgtagactccgtgaagggccgattcaccatctccagagacaattccaagaacacgctgtatctgcaaatgaacagcctgagagccgaggacacggctgtgtattactgtgcgagagaagtgggatttactgaggactactggggccagggaaccctggtcaccgtctcctca

SEQ ID NO: 31236 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDENNKYYVDSVKGRFTISRDNSKNTLYLQMNSLRAEDTAVYYCAREVGFTEDYWGQGTLVTVSS

SEQ ID NO: 31237 - DNA, 354 bp, Artificial Sequence
  Description of Artificial Sequence: Synthetic polynucleotide
caggtgcagctggtgcagtctgggactgaggtgaggaagcctggggcctcagtgaaggtctcctgcaaggcttctggatacaccttcaccaattatgatatcaactgggtacgacaggccactggacaaaggcttgagtggatgggatggatgcaccctaacagtggtaacacaggctatgcacagaagttccggggcagagtcaccatgaccaggaacacctccataaacacagcctacatggagctgaacagcctgagatctgaggacacggccgtatattattgtgcatatagcagtggctggaccctttttgactactggggccagggaaccctggtcaccgtctcctca

SEQ ID NO: 31238 - protein, 118 aa, Artificial Sequence
  Description of Artificial Sequence: Synthetic polypeptide
QVQLVQSGTEVRKPGASVKVSCKASGYTFTNYDINWVRQATGQRLEWMGWMHPNSGNTGYAQKFRGRVTMTRNTSINTAYMELNSLRSEDTAVYYCAYSSGWTLFDYWGQGTLVTVSS

SEQ ID NO: 31239 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataaacacagcctacatggagctgagcagcctgagatctgaggacacggccgtgtattactgtgcgtatagcagtggctggtaccgctttgactactggggccagggaaccctggtcaccgtctcctca

SEQ ID NO: 31240 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSINTAYMELSSLRSEDTAVYYCAYSSGWYRFDYWGQGTLVTVSS

SEQ ID NO: 31241 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcacccattatgatatcaactgggtgcgacaggccactggacaagggcttgagtggatgggatggatgcacccaaacagtggtaacacaggctatgcacagaagttccagggcagagtcaccatggccaggaacacctccataagcacagcctacatggagctgagcagcctgagatctgaggacacggccgtgtattactgtgcctatagcagtggctggtacaagtttgactactggggccagggaaccctggtcaccgtctcctca

SEQ ID NO: 31242 - protein, 118 aa, Artificial Sequence
  Description of Artificial Sequence: Synthetic polypeptide
QVQLVQSGAEVKKPGASVKVSCKASGYTFTHYDINWVRQATGQGLEWMGWMHPNSGNTGYAQKFQGRVTMARNTSISTAYMELSSLRSEDTAVYYCAYSSGWYKFDYWGQGTLVTVSS

SEQ ID NO: 31243 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcctatagcagtggctggtacaagtttgactactggggccagggaaccctggtcaccgtctcctca

SEQ ID NO: 31244 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTMTRNTSISTAYMELSSLRSEDTAVYYCAYSSGWYKFDYWGQGTLVTVSS

SEQ ID NO: 31245 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcaattatatggtatgatggaggttataaatactatgcagactccgtgaagggccgattcaccatctccagagacaattccaagaacacgctgtttctgcaaatgaacagcctgagagccgaggacacggctgtgtattactgtgcgagagatcactacgatttttggagtggttatcttacccactggggccagggaaccctggtcaccgtctcctca

SEQ ID NO: 31246 - protein, 121 aa, Artificial Sequence
  Description of Artificial Sequence: Synthetic polypeptide
QVQLVESGGGVVQPGRSLRLSCAASGFTFSTYGMHWVRQAPGKGLEWVAIIWYDGGYKYYADSVKGRFTISRDNSKNTLFLQMNSLRAEDTAVYYCARDHYDFWSGYLTHWGQGTLVTVSS

SEQ ID NO: 31247 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtatgatggaactaataaatactatacagactccgtgaagggccgattcaccatctccagagacaattccaagaacacgctgtatctgcaaatgaacagcctgagagccgaggacacggctgtgtattactgtgcgagagagggtcacgatttttggagtggctttttttgttactggggccagggaaccctggtcaccgtctcctca

SEQ ID NO: 31248 - protein, 121 aa, Artificial Sequence
  Description of Artificial Sequence: Synthetic polypeptide
QVQLVESGGGVVQPGRSLRLSCAASGFTFSNYGMHWVRQAPGKGLEWVAIIWYDGTNKYYTDSVKGRFTISRDNSKNTLYLQMNSLRAEDTAVYYCAREGHDFWSGFFCYWGQGTLVTVSS

SEQ ID NO: 31249 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaacgaacagcctgagagccgaggacacggctgtgtattactgtgcgagagagaggtatagcagcagctggtacgactacggtatggacgtctggggccaagggaccacggtcaccgtctcctca

SEQ ID NO: 31250 - protein, 123 aa, Artificial Sequence
  Description of Artificial Sequence: Synthetic polypeptide
QVQLVESGGGVVQPGRSLRLSCAASGFTFSDYGMHWVRQAPGKGLEWVAVIWYDGSNKYYADSVKGRFTISRDNSKNTLYLQTNSLRAEDTAVYYCARERYSSSWYDYGMDVWGQGTTVTVSS

SEQ ID NO: 31251 - DNA, 354 bp, Artificial Sequence; identical to SEQ ID NO: 31243
  Description of Artificial Sequence: Synthetic polynucleotide

SEQ ID NO: 31252 - protein, 118 aa, Artificial Sequence; identical to SEQ ID NO: 31244
  Description of Artificial Sequence: Synthetic polypeptide

SEQ ID NO: 31253 - DNA, 354 bp, Artificial Sequence; identical to SEQ ID NO: 31239
  Description of Artificial Sequence: Synthetic polynucleotide

SEQ ID NO: 31254 - protein, 118 aa, Artificial Sequence; identical to SEQ ID NO: 31240
  Description of Artificial Sequence: Synthetic polypeptide

SEQ ID NO: 31255 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggaatgggtggcaattatatggtatgatggaagtaataaatactatgcagactccgtgaagggccgattcaccatctccagagacaatttcaagaacacgctgtatctgcaaatgcacagcctgagagccgacgacacggctgtgtattactgtgcgagagagaattacgatttttggagtggttattatggctactggggccagggaaccctggtcaccgtctcctca

SEQ ID NO: 31256 - protein, 121 aa, Artificial Sequence
  Description of Artificial Sequence: Synthetic polypeptide
QVQLVESGGGVVQPGRSLRLSCAASGFTFSTYGMHWVRQAPGKGLEWVAIIWYDGSNKYYADSVKGRFTISRDNFKNTLYLQMHSLRADDTAVYYCARENYDFWSGYYGYWGQGTLVTVSS

SEQ ID NO: 31257 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagaggtataacagcggctggtacgactacggtttggacgtctggggccaagggaccacggtcaccgtctcctca

SEQ ID NO: 31258 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARERYNSGWYDYGLDVWGQGTTVTVSS

SEQ ID NO: 31259 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaagtatgcacagaagtttcagggcagggtcaccatgaccagggacacgtccatcagcacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31260 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTKYAQKFQGRVTMTRDTSISTAYMELSRLRFDDTAVFYCARDWGGYSSYYYGMDVWGQGTTVTVSS

SEQ ID NO: 31261 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgaggaaagtaataaatactatacagactccgtgaagggccgattcaccatctccagagacaattccaagaacacgctgtttctgcaaatgaacagcctgagagccgaggacacggctgtgtattactgtgcgagagaagtgggattcactgaggactactggggccagggaaccctggtcaccgtctcctca

SEQ ID NO: 31262 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAVIWYEESNKYYTDSVKGRFTISRDNSKNTLFLQMNSLRAEDTAVYYCAREVGFTEDYWGQGTLVTVSS

SEQ ID NO: 31263 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaagtatgcacagaagtttcagggcagggtcaccatgaccagggccacgtccatcagcacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31264 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTKYAQKFQGRVTMTRATSISTAYMELSRLRFDDTAVFYCARDWGGYSSYYYGMDVWGQGTTVTVSS

SEQ ID NO: 31265 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactctgcacagaagtttcagggccgggtcaccatgaccagggacacgtccatcagcacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31266 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTNSAQKFQGRVTMTRDTSISTAYMELSRLRFDDTAVFYCARDWGGYSSYYYGMDVWGQGTTVTVSS

SEQ ID NO: 31267 - DNA, 369 bp, Artificial Sequence
  Description of Artificial Sequence: Synthetic polynucleotide
caggtgcagctggtgcagtctgggggtgaggtgaagaagctgagggcctcagtgaaggtctcctgcaaggcttctggatacaccttcaccggctattatatacactgggtgcgacaggcccctggacaagggcttgagtggatgggatggatcaacccatacagtggtgacacaaactatgcacagaagtttcagggcagggtcaccatgaccagggacacgtccgtcagcacagcctacatggaactgagcaggttgagattggacgacacggccgtgttttactgtgcgagagattggggtggctacagttcttactactacggtatggacgtctggggccaagggaccccggtcaccgtctcttca

SEQ ID NO: 31268 - protein, 123 aa, Artificial Sequence
  Description of Artificial Sequence: Synthetic polypeptide
QVQLVQSGGEVKKLRASVKVSCKASGYTFTGYYIHWVRQAPGQGLEWMGWINPYSGDTNYAQKFQGRVTMTRDTSVSTAYMELSRLRLDDTAVFYCARDWGGYSSYYYGMDVWGQGTPVTVSS

SEQ ID NO: 31269 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaggtcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcctatagcagtggctggtactactttgactactggggccagggaaccctggtcaccgtctcctca

SEQ ID NO: 31270 - protein, 118 aa, Artificial Sequence
  Description of Artificial Sequence: Synthetic polypeptide
QVQLVQSGAEVKKPGASVKVSCRSSGYTFTNYDINWVRQATGQGLEWMGWMHPNSGNTGYAQKFQGRVTMTRNTSISTAYMELSSLRSEDTAVYYCAYSSGWYYFDYWGQGTLVTVSS

SEQ ID NO: 31271 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactatgcacagaagtttcagggcagggtcaccatgaccagggacacgtccatcagcacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31272 - protein, 123 aa, Artificial Sequence; identical to SEQ ID NO: 31196
  Description of Artificial Sequence: Synthetic polypeptide

SEQ ID NO: 31273 - DNA, 369 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactgtggcatgcactgggtccgccaggctccaggcaaggggctggagtgggtgacagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagagctgtatagcagcagctggtacgactacggtttggacgtctggggccaagggaccacggtcaccgtctcctca

SEQ ID NO: 31274 - protein, 123 aa, Artificial Sequence
  Description of Artificial Sequence: Synthetic polypeptide
QVQLVESGGGVVQPGRSLRLSCAASGFTFSNCGMHWVRQAPGKGLEWVTVIWYDGSNKYYADSVKGRFTISRDNSKNTLYLQMNSLRAEDTAVYYCARELYSSSWYDYGLDVWGQGTTVTVSS

SEQ ID NO: 31275 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcttatagcagtggctggtactactttgactactggggccagggaaccctggtcaccgtctcctca

SEQ ID NO: 31276 - protein, 118 aa, Artificial Sequence; identical to SEQ ID NO: 30230
  Description of Artificial Sequence: Synthetic polypeptide

SEQ ID NO: 31277 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactatgcacagaagtttcagggcagggtcaccatgaccagggacacgtccatcagcacagcctacatggaactgaggaggctgagatttgacgacacggccgtgttttactgtgcgagagattggggtggctacagttcttactactacggtatggacgtctggggccaagggaccacggtcaccgtctcttca

SEQ ID NO: 31278 - protein, 123 aa, Artificial Sequence; identical to SEQ ID NO: 31226
  Description of Artificial Sequence: Synthetic polypeptide

SEQ ID NO: 31279 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatacacactgggtgcgacaggcccctggacaagggcttgagtggatgggatggatcaacccttacagtggtggcacaaactatgcacagaagtttcagggcagggtcaccatgaccagggacacgtccatcagcacagcctacatggaactgagcaggctgagatttgacgacacggccgtgtattactgtgcgagagattggggtggctacagttcttactactacggtatggacgtctggggccaagggaccacggtcaccgtctcttca

SEQ ID NO: 31280 - protein, 123 aa, Artificial Sequence
  Description of Artificial Sequence: Synthetic polypeptide
QVQLVQSGAEVKKPGASVKVSCKASGYTFTGYYTHWVRQAPGQGLEWMGWINPYSGGTNYAQKFQGRVTMTRDTSISTAYMELSRLRFDDTAVYYCARDWGGYSSYYYGMDVWGQGTTVTVSS

SEQ ID NO: 31281 - DNA, 369 bp, Artificial Sequence
  Description of Artificial Sequence: Synthetic polynucleotide
caggtgcacctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaagtatgcacagaagtttcagggcagggtcaccatgaccagggacacgtccatcagcacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31282 - protein, 123 aa, Artificial Sequence
  Description of Artificial Sequence: Synthetic polypeptide
QVHLVQSGAEVKKPGASVKVSCKASGYTFTGYYIHWVRQAPGQGLEWMGWINPYSGDTKYAQKFQGRVTMTRDTSISTAYMELSRLRFDDTAVFYCARDWGGYSSYYYGMDVWGQGTTVTVSS

SEQ ID NO: 31283 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgttggaagtaatcaatactatgcagactccgtgaagggccgattcaccatctccagagacaattccaagaacacgctgtatctgcaaatgagcagcctgagagccgaggacacggctgtgtattactgtgcgagagaagtgggattcactgaggactactggggccagggaaccctggtcaccgtctcctcc

SEQ ID NO: 31284 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYVGSNQYYADSVKGRFTISRDNSKNTLYLQMSSLRAEDTAVYYCAREVGFTEDYWGQGTLVTVSS

SEQ ID NO: 31285 - DNA, 348 bp, Artificial Sequence
  Description of Artificial Sequence: Synthetic polynucleotide
gaggggcagctattggagtctgggggaggcttggtacagcctggggggtcactgagactctcctgtacagcctctggattcacctttagcacttttgccatgacctgggtccgccaggctccagggagggggctggagtgggtctcagttattagtggtagaggtggtagctcattctacgcagactccgtgaagggccggttcaccatctccagagacaataccaagaacacgctgtatctgcaaatgaacagcctgagagccgaggacacggccgtatattactgtgcgaaagatcaactatggtttgactactggggccagggaaccctggtcaccgtctcctca

SEQ ID NO: 31286 - protein, 116 aa, Artificial Sequence
  Description of Artificial Sequence: Synthetic polypeptide
EGQLLESGGGLVQPGGSLRLSCTASGFTFSTFAMTWVRQAPGRGLEWVSVISGRGGSSFYADSVKGRFTISRDNTKNTLYLQMNSLRAEDTAVYYCAKDQLWFDYWGQGTLVTVSS

SEQ ID NO: 31287 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggactgggtggcagttatatggtatgaagaaagtaataaatactatgcagactccgtgaagggccgattcaccatctccagagacaattccaagaacacgctgtatctgcaaatgaacagcctgagagccgaggacacggctatgtattactgtgcgagagaagtgggattcactgaggactactggggccagggaaccctggtcaccgtctcctca

SEQ ID NO: 31288 - protein, 117 aa, Artificial Sequence
  Description of Artificial Sequence: Synthetic polypeptide
QVQLVESGGGVVQPGRSLRLSCAASGFTFSNYGMHWVRQAPGKGLDWVAVIWYEESNKYYADSVKGRFTISRDNSKNTLYLQMNSLRAEDTAMYYCAREVGFTEDYWGQGTLVTVSS

SEQ ID NO: 31289 - DNA, 354 bp, Artificial Sequence; identical to SEQ ID NO: 31243
  Description of Artificial Sequence: Synthetic polynucleotide

SEQ ID NO: 31290 - protein, 118 aa, Artificial Sequence; identical to SEQ ID NO: 31244
  Description of Artificial Sequence: Synthetic polypeptide

SEQ ID NO: 31291 - DNA, 354 bp, Artificial Sequence
  Description of Artificial Sequence: Synthetic polynucleotide
caggtgcagctggtgcagtctggggctgaggtgaagaagcctagggcctcagtgaaggtctcctgcaaggcttctggacacaccttcaccaattatgatatcaactgggtgcgacaggccactggacaagggcttgagtggatgggatggatgcatcctaacagtggtaacacaggctatgcacagaagttccagggcagagtcaccatgaccaggaacacctccataagcaccgcctacatggagctgagcagcctgagatctgaggacacggccgtgtattactgtgcatatagcagtggctggtaccgctttgactactggggccagggaaccctggtcaccgtctcctca

SEQ ID NO: 31292 - protein, 118 aa, Artificial Sequence
  Description of Artificial Sequence: Synthetic polypeptide
QVQLVQSGAEVKKPRASVKVSCKASGHTFTNYDINWVRQATGQGLEWMGWMHPNSGNTGYAQKFQGRVTMTRNTSISTAYMELSSLRSEDTAVYYCAYSSGWYRFDYWGQGTLVTVSS

SEQ ID NO: 31293 - DNA, 369 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacccttacagtggtgacacaaactatgcacagaagtttcagggcagggtcaccatgaccagggacacgtccgtcagcacagcctacatggaactgagcaggctgagatttgacgacacggccgtgttttactgtgcgagagattggggtggctacagttcttactactacggtatggacgtctggggccaagggaccacggtcaccgtctcttca

SEQ ID NO: 31294 - protein, 123 aa, Artificial Sequence
  Description of Artificial Sequence: Synthetic polypeptide
QVQLVQSGAEVKKPGASVKVSCKASGYTFTGYYIHWVRQAPGQGLEWMGWINPYSGDTNYAQKFQGRVTMTRDTSVSTAYMELSRLRFDDTAVFYCARDWGGYSSYYYGMDVWGQGTTVTVSS

SEQ ID NO: 31295 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcagggcttctggatacaccttcaccaattatgatatcaactgggtgcgacaggccactggacgagggcttgagtggatgggatggatgtaccctaacagtggtaacacaggctatgcacagaagttccagggcagagtcaccatgaccaggaacacctccataagcacagcctacatggagctgagcagcctgagatctgaggacacggccgtgtattactgtgcgcttagcagtggctggtactggttcgacccctggggccagggaaccctggtcaccgtctcctca

SEQ ID NO: 31296 - protein, 118 aa, Artificial Sequence
  Description of Artificial Sequence: Synthetic polypeptide
QVQLVQSGAEVKKPGASVKVSCRASGYTFTNYDINWVRQATGRGLEWMGWMYPNSGNTGYAQKFQGRVTMTRNTSISTAYMELSSLRSEDTAVYYCALSSGWYWFDPWGQGTLVTVSS

SEQ ID NO: 31297 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgcaccctaacagtggtaacacaggctatgcacagaagttccagggccgagtcaccatgaccaggaacacctccataagcacagcctacatggaactgagcagcctgagatctgaggacacggccgtgtattactgtgcgtatagcagtggctggtactactttgactactggggccagggaaccctggtcaccgtctcctca

SEQ ID NO: 31298 - protein, 118 aa, Artificial Sequence; identical to SEQ ID NO: 30230
  Description of Artificial Sequence: Synthetic polypeptide

SEQ ID NO: 31299 - DNA, 339 bp, Artificial Sequence
  Description of Artificial Sequence: Synthetic polynucleotide
gaggtgcagctggtggagtctgggggaggcctggtcaagcctggggggtccctgagactctcctgtgcagtctctggattcaccttcagtacctatagcatgaactgggtccgccaggctccagggaaggggctggagtgggtctcatccattagtagtagtattaattacatgtactacgcagactcagtgaagggccgattcaccatctccagagacaacgccaagaactcactgtatctgcaaatgaacagcctgagagccgaggactcggctgtgtattactgtgcgagattaggggtctactggggccagggaaccctggtcaccgtctcctca

SEQ ID NO: 31300 - protein, 113 aa, Artificial Sequence
  Description of Artificial Sequence: Synthetic polypeptide
EVQLVESGGGLVKPGGSLRLSCAVSGFTFSTYSMNWVRQAPGKGLEWVSSISSSINYMYYADSVKGRFTISRDNAKNSLYLQMNSLRAEDSAVYYCARLGVYWGQGTLVTVSS

SEQ ID NO: 31301 - DNA, 351 bp, Artificial Sequence
  Description of Artificial Sequence: Synthetic polynucleotide
caggtgcagctggtggagtctgggggaggcgtggtccagcctgggaagtccctgagactctcctgtgcagcgtctggattcaccttcagtaactatggcatgcactgggtccgccaggctccaggcaaggggctggagtgggtggcagttatatggtatattggaagtaatcaatactatgcggactccgtgaagggccgattcaccatctccagagacaattccaagaacacgctgtatctgcaaatgagcagcctgagagccgaggacacggctgtgtattactgtgcgagagaagtgggattcactgaggactactggggccagggaaccctggtcaccgtctcctcc

SEQ ID NO: 31302 - protein, 117 aa, Artificial Sequence
  Description of Artificial Sequence: Synthetic polypeptide
QVQLVESGGGVVQPGKSLRLSCAASGFTFSNYGMHWVRQAPGKGLEWVAVIWYIGSNQYYADSVKGRFTISRDNSKNTLYLQMSSLRAEDTAVYYCAREVGFTEDYWGQGTLVTVSS

SEQ ID NO: 31303 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcttctggattcacctttagcagctatgccatgagctgggtccgccaggctccagggaaggggctggagtgggtctcagttattagtggtggtggtagtagcacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31304 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGGGSSTYYADSVKGRFTISRDNSKNTLYLQMNSLRAEDTAVYYCAKWRGNPTDYGMDVWGQGTTVTVSS

SEQ ID NO: 31305 - DNA, 363 bp, Artificial Sequence
  Description of Artificial Sequence: Synthetic polynucleotide
gaggtgcaactgttggagtctgggggaggcttggtacagccgggggggtccctgagactctcctgtgcagcctctggaatcacctttagcagctatgccatgagctgggtccgccaggctccagggaaggggctggagtgggtctcagttattagtggtggtggtagtagcacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31306 - protein, 121 aa, Artificial Sequence
  Description of Artificial Sequence: Synthetic polypeptide
EVQLLESGGGLVQPGGSLRLSCAASGITFSSYAMSWVRQAPGKGLEWVSVISGGGSSTYYADSVKGRFTISRDNSKNTLYLQMNSLRAEDTAVYYCAKWRGNPTDYGMDVWGQGTTVTVSS

SEQ ID NO: 31307 - DNA, 363 bp, Artificial Sequence
  Description of Artificial Sequence: Synthetic polynucleotide
gaggtgcaactgttggagtctgggggaggcctggtacagcctggggggtccctgagactctcctgtgcagcctctggattcacctttagcagctatgccatgagctgggtccgccaggctccagggaaggggctggagtgggtctcagttattagtggtggtggtagtagcacatactacgcagactccgtgaagggccggttcaccatctccagagacaattccaagaacacgctgcatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31308 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGGGSSTYYADSVKGRFTISRDNSKNTLHLQMNSLRAEDTAVYYCAKWRGNPTDYGMDVWGQGTTVTVSS

SEQ ID NO: 31309 - DNA, 375 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtaactataacatgaactgggtccgccaggctccagggaaggggctggagtgggtttcatacattagtagaagtagtaataccaaatactatgtagactctgtgaagggccgattcaccatctccagagacaatgccaagaactcattgtatctgcaaatgaacagcctgagagacgaggacacggctgtgtattactgtgcgagagataggagtgggagctacgggtacttctactactacggtttggacgtctggggccaagggaccacggtcaccgtctcctca

SEQ ID NO: 31310 - protein, 125 aa, Artificial Sequence
  Description of Artificial Sequence: Synthetic polypeptide
EVQLVESGGGLVQPGGSLRLSCAASGFTFSNYNMNWVRQAPGKGLEWVSYISRSSNTKYYVDSVKGRFTISRDNAKNSLYLQMNSLRDEDTAVYYCARDRSGSYGYFYYYGLDVWGQGTTVTVSS

SEQ ID NO: 31311 - DNA, 387 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaatagtggtaacacaggctatgcacagaagttccagggcagagtcaccatgaccaggaacacctccataagcacagcctatatggagctgagaagcctgagatctgaggacacggccgtgtattactgtgcgagagcggatattgtattagtaccagctgctatcccttataattactacttcgctatggacgtctggggccaagggaccacggtcaccgtctcctca

SEQ ID NO: 31312 - protein, 129 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELRSLRSEDTAVYYCARADIVLVPAAIPYNYYFAMDVWGQGTTVTVSS

SEQ ID NO: 31313 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcagttattagtggtggtggtagtagtacatactacgcagactccgtgaagggccggttcaccctctccagagacaattccaagaacacgctgtatctgcaaatgaacagcctgagagccgaggacacggccgttttttactgtgcgaaatggcgaggtaaccccactgactacggtatggacgtctggggccaagggaccacggtcaccgtctcctca

SEQ ID NO: 31314 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGGGSSTYYADSVKGRFTLSRDNSKNTLYLQMNSLRAEDTAVFYCAKWRGNPTDYGMDVWGQGTTVTVSS

SEQ ID NO: 31315 - DNA, 384 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactactatttgcactgggtgcgacaggcccctggacaagggcttgagtggatgggatggatcaaccctaacagtggtgacacaaactatgcacagaagtttcagggcagggtcaccatgaccagggacacgtccatcagcacagcctacatggagctgagcaggctgagatctgacgacacggccgtgtattactgtgcgagagatcgggactctggttcggggagttacccctactactactactacggtatggacgtctggggccaagggaccacggtcaccgtctcctca

SEQ ID NO: 31316 - protein, 128 aa, Artificial Sequence
  Description of Artificial Sequence: Synthetic polypeptide
QVQLVQSGAEVKKPGASVKVSCKASGYTFTDYYLHWVRQAPGQGLEWMGWINPNSGDTNYAQKFQGRVTMTRDTSISTAYMELSRLRSDDTAVYYCARDRDSGSGSYPYYYYYGMDVWGQGTTVTVSS

SEQ ID NO: 31317 - DNA, 378 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgtgactacggtgaccccccctactactactactacggtatggacgtctggggccaagggaccacggtcaccgtctcctca

SEQ ID NO: 31318 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRDYGDPPYYYYYGMDVWGQGTTVTVSS

SEQ ID NO: 31319 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagatatatggtttgatggcagtaataaatactatgtagactccgtgaaggaccgattcaccatctccagagacaattccaagaacacgctgtatctgcaaatgaacagcctgagagccgaggacacggctgtttattactgtgcgagagatcgggtggagggttcggggactccctactactactacggtatggacgtctggggccaagggaccacggtcaccgtctcctca

SEQ ID NO: 31320 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVADIWFDGSNKYYVDSVKDRFTISRDNSKNTLYLQMNSLRAEDTAVYYCARDRVEGSGTPYYYYGMDVWGQGTTVTVSS

SEQ ID NO: 31321 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatggtatggtggaagtgataaagactatgcagactccgtgaagggccgattcaccatctccagagacatttccaagaacacgctgtatctgcaaatgaacagcctgagagccgaggacacggctgtgtattactgtgcgagagatcgggattattgtagtggtggtacttgtccttactactactactacggtatggacgtctggggccaagggaccacggtcaccgtctcctca

SEQ ID NO: 31322 - protein, 129 aa, Artificial Sequence
  Description of Artificial Sequence: Synthetic polypeptide
QVQLVESGGGVVQPGRSLRLSCAASGFTFSTYGMHWVRQAPGKGLEWVAVIWYGGSDKDYADSVKGRFTISRDISKNTLYLQMNSLRAEDTAVYYCARDRDYCSGGTCPYYYYYGMDVWGQGTTVTVSS

SEQ ID NO: 31323 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatggtatggtggaagtgataaagactatgcagactccgtgaagggccgattcaccatctccagagacatttccaagaacacgctgtatctgcaaatgaacagcctgagagccgaggacacggctgtgtattactgtgcgagagatcgggattattgtagtggtggtagctgcccttactactactactacggtatggacgtctggggccaagggaccacggtcaccgtctcctca

SEQ ID NO: 31324 - protein, 129 aa, Artificial Sequence
  Description of Artificial Sequence: Synthetic polypeptide
QVQLVESGGGVVQPGRSLRLSCAASGFTFSTYGMHWVRQAPGKGLEWVAVIWYGGSDKDYADSVKGRFTISRDISKNTLYLQMNSLRAEDTAVYYCARDRDYCSGGSCPYYYYYGMDVWGQGTTVTVSS

SEQ ID NO: 31325 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcaactatgtcatgagctgggtccgccaggctccagggaaggggctggagtgggtctcagttattagtggtggtggtagtagtacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31326 - protein, 121 aa, Artificial Sequence
  Description of Artificial Sequence: Synthetic polypeptide
EVQLLESGGGLVQPGGSLRLSCAASGFTFSNYVMSWVRQAPGKGLEWVSVISGGGSSTYYADSVKGRFTISRDNSKNTLYLQMNSLRAEDTAVYYCAKWRGNPTDYGMDVWGQGTTVTVSS

SEQ ID NO: 31327 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcagttattagtggtggtggtagtagcacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31328 - protein, 121 aa, Artificial Sequence; identical to SEQ ID NO: 31304
  Description of Artificial Sequence: Synthetic polypeptide

SEQ ID NO: 31329 - DNA, 369 bp, Artificial Sequence
  Description of Artificial Sequence: Synthetic polynucleotide
caggtgcagctgcaggagtcgggcccaggactggtgaatccttcacagaccctgtccctcacctgcgctgtctctggtggctccatcagcagtggttattaccactggagctggatccgccagcacccagggaagggcctggagtggattgggtacatctattacagtgggagcacctactacaacccgtccctcaagagtcgagttaccatatcagttgacacgtctaagaaccagttctccctgaagctgacctctgtgactgccgcggacacggccgtgtattactgtgcgagagattggggtggctacgattcgagtggctggttcgacccctggggccagggaaccctggtcaccgtctcctca

SEQ ID NO: 31330 - protein, 123 aa, Artificial Sequence
  Description of Artificial Sequence: Synthetic polypeptide
QVQLQESGPGLVNPSQTLSLTCAVSGGSISSGYYHWSWIRQHPGKGLEWIGYIYYSGSTYYNPSLKSRVTISVDTSKNQFSLKLTSVTAADTAVYYCARDWGGYDSSGWFDPWGQGTLVTVSS

SEQ ID NO: 31331 - DNA, 375 bp, Artificial Sequence
  Description of Artificial Sequence: Synthetic polynucleotide
gaggtgaagctggtggagtctgggggaggcttggtacagcctggggagtccctgagactctcctgtgtagcctctggattcaccttcagtaactataacatgaactgggtccgccaggctccagggaagggactggagtgggtttcatacattagtagaagtagtaataccaaatactacgcagactctgtgaggggccgattcaccatctccagagacaatgccaagaattcactatatctgcaaatgaacagcctgagagacgaggacacggctgtgtattactgtgcgagagataggagtgggagctacgggtacttctactactacggtttggacgtctggggccaagggaccacggtcaccgtctcctca

SEQ ID NO: 31332 - protein, 125 aa, Artificial Sequence
  Description of Artificial Sequence: Synthetic polypeptide
EVKLVESGGGLVQPGESLRLSCVASGFTFSNYNMNWVRQAPGKGLEWVSYISRSSNTKYYADSVRGRFTISRDNAKNSLYLQMNSLRDEDTAVYYCARDRSGSYGYFYYYGLDVWGQGTTVTVSS

SEQ ID NO: 31333 - DNA, 375 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctataacatgaactgggtccgccaggctccagggaaggggctggagtgggtttcatacattagtagaagtagtaataccaaacactacgcagactctgtgaagggccgattcaccatctccagagacaatgccaagaactcactgtatctgcaaatggacagcctgagagacgaggacacggctgtgtattactgtgcgagagataggagtgggagctacgggtacttctactactacggtttggacgtctggggccaagggaccacggtcaccgtctcctca

SEQ ID NO: 31334 - protein, 125 aa, Artificial Sequence
  Description of Artificial Sequence: Synthetic polypeptide
EVQLVESGGGLVQPGGSLRLSCAASGFTFSSYNMNWVRQAPGKGLEWVSYISRSSNTKHYADSVKGRFTISRDNAKNSLYLQMDSLRDEDTAVYYCARDRSGSYGYFYYYGLDVWGQGTTVTVSS

SEQ ID NO: 31335 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcagttattagtggtggtggtagtagcacatactacgcagactccgtgaagggccggttcaccatctccagagacaattccaagaacatgctgcatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31336 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGGGSSTYYADSVKGRFTISRDNSKNMLHLQMNSLRAEDTAVYYCAKWRGNPTDYGMDVWGQGTTVTVSS

SEQ ID NO: 31337 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgtgactacggtgaccccccctactactactactacggtatggacgtctggggccaagggaccacggtcaccgtctcctca

SEQ ID NO: 31338 - protein, 126 aa, Artificial Sequence; identical to SEQ ID NO: 31318
  Description of Artificial Sequence: Synthetic polypeptide

SEQ ID NO: 31339 - DNA, 387 bp, Artificial Sequence; identical to SEQ ID NO: 31321
  Description of Artificial Sequence: Synthetic polynucleotide

SEQ ID NO: 31340 - protein, 129 aa, Artificial Sequence; identical to SEQ ID NO: 31322
  Description of Artificial Sequence: Synthetic polypeptide

SEQ ID NO: 31341 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatcccatgagctgggtccgccaggctcccgggaaggggctggagtgggtctcagttattagtggtggtggtagtagtgcatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31342 - protein, 121 aa, Artificial Sequence
  Description of Artificial Sequence: Synthetic polypeptide
EVQLLESGGGLVQPGGSLRLSCAASGFTFSSYPMSWVRQAPGKGLEWVSVISGGGSSAYYADSVKGRFTISRDNSKNTLYLQMNSLRAEDTAVYYCAKWRGNPTDYGMDVWGQGTTVTVSS

SEQ ID NO: 31343 - DNA, 375 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctataacatgaactgggtccgccaggctccagggaaggggctggagtgggtttcatacattagtagaagtagtaataccaaacactacgcagactctgtgaagggccgattcaccatctccagagacaatgccaagaactcactgtatctgcaaatgaacagcctgagagacgaggacacggctgtgtattactgtgcgagagataggagtgggagctacgggtacttctactactacggtttggacgtctggggccaagggaccacggtcaccgtctcctca

SEQ ID NO: 31344 - protein, 125 aa, Artificial Sequence
  Description of Artificial Sequence: Synthetic polypeptide
EVQLVESGGGLVQPGGSLRLSCAASGFTFSSYNMNWVRQAPGKGLEWVSYISRSSNTKHYADSVKGRFTISRDNAKNSLYLQMNSLRDEDTAVYYCARDRSGSYGYFYYYGLDVWGQGTTVTVSS

SEQ ID NO: 31345 - DNA, 363 bp, Artificial Sequence
  Description of Artificial Sequence: Synthetic polynucleotide
gaggtgcagctggtggagtctgggggaggcttggtccagcctggggggtccctgagactctcctgtgcagcctctggattcacctttagtggctattggatgaactgggtccgccaggctccagggaaggggctggagtgggtggccaacataaagcaagatggaagtgagaaatactatgtggactctgtgaagggccgattcaccatctccagagacaacgccaagaattcactgtatctgcaaatgaacagcctgagagccgaggacacggctgtgtattactgtgcgagagggatgtatagcagtggctggtacgtctttgactactggggccagggaaccctggtcaccgtctcctca

SEQ ID NO: 31346 - protein, 121 aa, Artificial Sequence
  Description of Artificial Sequence: Synthetic polypeptide
EVQLVESGGGLVQPGGSLRLSCAASGFTFSGYWMNWVRQAPGKGLEWVANIKQDGSEKYYVDSVKGRFTISRDNAKNSLYLQMNSLRAEDTAVYYCARGMYSSGWYVFDYWGQGTLVTVSS

SEQ ID NO: 31347 - DNA, 363 bp, Artificial Sequence; identical to SEQ ID NO: 31327
  Description of Artificial Sequence: Synthetic polynucleotide

SEQ ID NO: 31348 - protein, 121 aa, Artificial Sequence; identical to SEQ ID NO: 31304
  Description of Artificial Sequence: Synthetic polypeptide

SEQ ID NO: 31349 - DNA, 360 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgaactgggtccgccgggctccagggaaggggctggagtgggtctcagccattagtagtactggtagttacatatattacgcagactcagtgaagggccgattcaccatctccagagacaacgccaagaactcactgtatctgcaaatgaacagcctgagagccgaggacacggctgtgtattactgtgcgaggacggcagtggctggtactgggtggttcgacccctggggccagggaaccctggtcaccgtctcctca

SEQ ID NO: 31350 - protein, 120 aa, Artificial Sequence
  Description of Artificial Sequence: Synthetic polypeptide
EVQLVESGGGLVKPGGSLRLSCAASGFTFSSYSMNWVRRAPGKGLEWVSAISSTGSYIYYADSVKGRFTISRDNAKNSLYLQMNSLRAEDTAVYYCARTAVAGTGWFDPWGQGTLVTVSS

SEQ ID NO: 31351 - DNA, 363 bp, Artificial Sequence
  Description of Artificial Sequence: Synthetic polynucleotide
gaggtgcaactgttggagtctgggggaggcttggtacagcctggggggtccctgagattctcctgtgcagcctctggattcacctttagcagccacgccatgagctgggtccgccaggctccagggaaggggctggagtgggtctcagttataagtggaggtggtagtagcacatattacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31352 - protein, 121 aa, Artificial Sequence
  Description of Artificial Sequence: Synthetic polypeptide
EVQLLESGGGLVQPGGSLRFSCAASGFTFSSHAMSWVRQAPGKGLEWVSVISGGGSSTYYADSVKGRFTISRDNSKNTLYLQMNSLRAEDTAVYYCAKWRGNPTDYGMDVWGQGTTVTVSS

SEQ ID NO: 31353 - DNA, 378 bp, Artificial Sequence; identical to SEQ ID NO: 31337
  Description of Artificial Sequence: Synthetic polynucleotide

SEQ ID NO: 31354 - protein, 126 aa, Artificial Sequence; identical to SEQ ID NO: 31318
  Description of Artificial Sequence: Synthetic polypeptide

SEQ ID NO: 31355 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatggtatggtggaagtaataaagactatgcagactccgtgaagggccgattcaccatctccagagacaattccaagaacacgctgtatctgcaaatgaacagtttgagagccgaggacacggctgtgtattactgtgcgagagatcgggattattgtagtggtggtacctgcccttactactactactacggtatggacgtctggggccaagggaccacggtcaccgtctcctca

SEQ ID NO: 31356 - protein, 129 aa, Artificial Sequence
  Description of Artificial Sequence: Synthetic polypeptide
QVQLVESGGGVVQPGRSLRLSCAASGFTFSTYGMHWVRQAPGKGLEWVAVIWYGGSNKDYADSVKGRFTISRDNSKNTLYLQMNSLRAEDTAVYYCARDRDYCSGGTCPYYYYYGMDVWGQGTTVTVSS

SEQ ID NO: 31357 - DNA, 363 bp, Artificial Sequence; identical to SEQ ID NO: 31327
  Description of Artificial Sequence: Synthetic polynucleotide

SEQ ID NO: 31358 - protein, 121 aa, Artificial Sequence; identical to SEQ ID NO: 31304
  Description of Artificial Sequence: Synthetic polypeptide

SEQ ID NO: 31359 - DNA, 375 bp, Artificial Sequence
  Description of Artificial Sequence: Synthetic polynucleotide
gagatgcagctggtggagtctgggggaggcttggtacagcctggggggtccctgagactctcctgtgcagcctctggattcaccttcagtagctataacatgaactgggtccgccaggttccagggaaggggctggagtgggtttcatacattagtagaagtagtaataccaaacactacgcagactctgtgaagggccgattcaccatctccagagacaatgccaagaactcactgtatctgcaaatgaacagcctgagagacgaggacacggctgtgtattactgtgcgagagataggagtgggagctacgggtacttctactactacggtttggacgtctggggccaagggaccacggtcaccgtctcctca

SEQ ID NO: 31360 - protein, 125 aa, Artificial Sequence
  Description of Artificial Sequence: Synthetic polypeptide
EMQLVESGGGLVQPGGSLRLSCAASGFTFSSYNMNWVRQVPGKGLEWVSYISRSSNTKHYADSVKGRFTISRDNAKNSLYLQMNSLRDEDTAVYYCARDRSGSYGYFYYYGLDVWGQGTTVTVSS

SEQ ID NO: 31361 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcacctatgccatgagctgggtccgccaggctccagggaaggggctggagtgggtctcaattattagtggtggtggtagtagcacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31362 - protein, 121 aa, Artificial Sequence
  Description of Artificial Sequence: Synthetic polypeptide
EVQLLESGGGLVQPGGSLRLSCAASGFTFSTYAMSWVRQAPGKGLEWVSIISGGGSSTYYADSVKGRFTISRDNSKNTLYLQMNSLRAEDTAVYYCAKWRGNPTDYGMDVWGQGTTVTVSS

SEQ ID NO: 31363 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatggtatggtggaagtaatacagactatgcagactccgtgaagggccgattcaccatctccagagacatttccaagaacacgctgtatctgcaaatgaacagcctgagagccgaggacacggctgtgtattactgtgcgagagatcgggattattgtagtggtactagctgcccttactactactactacggtatggacgtctggggccaagggaccacggtcaccgtctcctca

SEQ ID NO: 31364 - protein, 129 aa, Artificial Sequence
  Description of Artificial Sequence: Synthetic polypeptide
QVQLVESGGGVVQPGRSLRLSCAASGFTFSTYGMHWVRQAPGKGLEWVAVIWYGGSNTDYADSVKGRFTISRDISKNTLYLQMNSLRAEDTAVYYCARDRDYCSGTSCPYYYYYGMDVWGQGTTVTVSS

SEQ ID NO: 31365 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcaccttcagcagctatgccatgagctgggtccgccaggctccagggaaggggctggagtgggtctcagttattagtggtggtggtagtagcacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31366 - protein, 121 aa, Artificial Sequence; identical to SEQ ID NO: 31304
  Description of Artificial Sequence: Synthetic polypeptide

SEQ ID NO: 31367 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcacttatatggtatgatggaagtaataaatactatgcagactccgtgaagggccgattcaccatctccagagacaattccaagaacacgctgtatctacaaatgaacagcctgagagccgaggacacggctgtgtattactgtgcgagagatgaccgatcttgtagtagaaccagctgcccttactactactactacggtttggacgtctggggccaagggaccacggtcatcgtctcctca

SEQ ID NO: 31368 - protein, 129 aa, Artificial Sequence
  Description of Artificial Sequence: Synthetic polypeptide
QVQLVESGGGVVQPGRSLRLSCAASGFTFSDYGMHWVRQAPGKGLEWVALIWYDGSNKYYADSVKGRFTISRDNSKNTLYLQMNSLRAEDTAVYYCARDDRSCSRTSCPYYYYYGLDVWGQGTTVIVSS

SEQ ID NO: 31369 - DNA, 363 bp, Artificial Sequence; identical to SEQ ID NO: 31327
  Description of Artificial Sequence: Synthetic polynucleotide

SEQ ID NO: 31370 - protein, 121 aa, Artificial Sequence; identical to SEQ ID NO: 31304
  Description of Artificial Sequence: Synthetic polypeptide

SEQ ID NO: 31371 - DNA, 363 bp, Artificial Sequence; identical to SEQ ID NO: 31365
  Description of Artificial Sequence: Synthetic polynucleotide

SEQ ID NO: 31372 - protein, 121 aa, Artificial Sequence; identical to SEQ ID NO: 31304
  Description of Artificial Sequence: Synthetic polypeptide

SEQ ID NO: 31373 - DNA, 387 bp, Artificial Sequence; identical to SEQ ID NO: 31367
  Description of Artificial Sequence: Synthetic polynucleotide

SEQ ID NO: 31374 - protein, 129 aa, Artificial Sequence; identical to SEQ ID NO: 31368
  Description of Artificial Sequence: Synthetic polypeptide

SEQ ID NO: 31375 - DNA, 363 bp, Artificial Sequence; identical to SEQ ID NO: 31327
  Description of Artificial Sequence: Synthetic polynucleotide

SEQ ID NO: 31376 - protein, 121 aa, Artificial Sequence; identical to SEQ ID NO: 31304
  Description of Artificial Sequence: Synthetic polypeptide

SEQ ID NO: 31377 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcagttattagtggtggtggtagtagcacatactacgcagactccgtgaagggccggttcaccatctccagagacaattccaagaacacgctgtatctgcaaatgaacagcctgagagccgaggacacggccgtatattactgtgcgaaatggcgaggtaaccccactgactccggtatggacgtctggggccaagggaccacggtcaccgtctcctca

SEQ ID NO: 31378 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGGGSSTYYADSVKGRFTISRDNSKNTLYLQMNSLRAEDTAVYYCAKWRGNPTDSGMDVWGQGTTVTVSS

SEQ ID NO: 31379 - DNA, 387 bp, Artificial Sequence
  Description of Artificial Sequence: Synthetic polynucleotide
caggtgcaggtggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctacaaatgaacagcctgagagccgaggacacggctgtgtattactgtgcgagagatgaccgatcttgtagtagtaccagctgcccttactactactactacggtttggacgtctggggccaagggaccacggtcaccgtctcctca

SEQ ID NO: 31380 - protein, 129 aa, Artificial Sequence
  Description of Artificial Sequence: Synthetic polypeptide
QVQVVESGGGVVQPGRSLRLSCAASGFTFSDYGMHWVRQAPGKGLEWVAVIWYDGSNKYYADSVKGRFTISRDNSKNTLYLQMNSLRAEDTAVYYCARDDRSCSSTSCPYYYYYGLDVWGQGTTVTVSS

SEQ ID NO: 31381 - DNA, 387 bp, Artificial Sequence
  Description of Artificial Sequence: Synthetic polynucleotide
caggtgcagctgatggagtctgggggaggcgtggtccagcctgggaggtccctgagactctcctgtgcagcgtctggattcaccttcagtgactatggcatgcactgggtccgccaggctccaggcaaggggctggagtgggtggcacttatatggtatgatggaagtaataaatactatgcagactccgtgaagggccgattcaccatctccagagacaattccaagaacacgctttatctacaaatgaacagcctgagagccgaggacacggctgtgtattactgtgcgagagatgaccgatcttgtagtagaaccagctgcccttactactactactacggtttggacgtctggggccaagggaccacggtcatcgtctcctca

SEQ ID NO: 31382 - protein, 129 aa, Artificial Sequence
  Description of Artificial Sequence: Synthetic polypeptide
QVQLMESGGGVVQPGRSLRLSCAASGFTFSDYGMHWVRQAPGKGLEWVALIWYDGSNKYYADSVKGRFTISRDNSKNTLYLQMNSLRAEDTAVYYCARDDRSCSRTSCPYYYYYGLDVWGQGTTVIVSS

SEQ ID NO: 31383 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtaactatggcatgcactgggtccgccaggctccaggcaaggggctggagtgggtggcagttatatggtttgatggcagtaataaatactatgttgactccgtgaaggaccgattcaccatctccagagacaattccaagaacacgctatatctgcaaatgaacagcctgagagccgaagacacggctgtgtattactgtgcgagagatcgggtggagggttcggggactccctactactactacggtatggacgtctggggccaagggaccacggtcaccgtctcctca

SEQ ID NO: 31384 - protein, 126 aa, Artificial Sequence
  Description of Artificial Sequence: Synthetic polypeptide
QVQLVESGGGVVQPGRSLRLSCAASGFTLSNYGMHWVRQAPGKGLEWVAVIWFDGSNKYYVDSVKDRFTISRDNSKNTLYLQMNSLRAEDTAVYYCARDRVEGSGTPYYYYGMDVWGQGTTVTVSS

SEQ ID NO: 31385 - DNA, 387 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccgtcagtacctatggcatgcactgggtccgccaggctccaggcaaggggctggagtgggtggcagttatatggtatggtggaagtaataaagactatgcagactccgtgaagggccgattcaccatctccagagacatttccaagaacacgctgtatctgcaaatgaacagcctgagagccgaggacacggctgtgtattactgtgcgagagatcgggattattgtagtggtggtagctgtccttactactactactacggtatggacgtctggggccaagggaccacggtcaccgtctcctca

SEQ ID NO: 31386 - protein, 129 aa, Artificial Sequence
  Description of Artificial Sequence: Synthetic polypeptide
QVQLVESGGGVVQPGRSLRLSCAASGFTVSTYGMHWVRQAPGKGLEWVAVIWYGGSNKDYADSVKGRFTISRDISKNTLYLQMNSLRAEDTAVYYCARDRDYCSGGSCPYYYYYGMDVWGQGTTVTVSS

SEQ ID NO: 31387 - DNA, 387 bp, Artificial Sequence
  Description of Artificial Sequence: Synthetic polynucleotide
caggtgcagctggtggagtctgggggaggcgtggtccagcctgggaggtccctgagactctcctgtacagcgtctggattcaccttcagtacctatggcatgcactgggtccgccaggctccaggcaaggggctggagtgggtggcagttgtatggtatggtggaaataataaagactatgcagactccgtgaagggccgattcaccatctccagagacatttccaagaacacactgtatctgcaaatgaacagcctgagagccgaggacacggctgtgtattactgtgcgagagatcgggattattgtagtggtggtagctgcccttactactactactacggtatggacgtctggggccaagggaccacggtcaccgtctcctca

SEQ ID NO: 31388 - protein, 129 aa, Artificial Sequence
  Description of Artificial Sequence: Synthetic polypeptide
QVQLVESGGGVVQPGRSLRLSCTASGFTFSTYGMHWVRQAPGKGLEWVAVVWYGGNNKDYADSVKGRFTISRDISKNTLYLQMNSLRAEDTAVYYCARDRDYCSGGSCPYYYYYGMDVWGQGTTVTVSS

SEQ ID NO: 31389 - DNA, 363 bp, Artificial Sequence
  Description of Artificial Sequence: Synthetic polynucleotide
gaggtgcaactgttggagtctgggggaggcttgatacagcctggggggtccctgagactctcctgtgcagcctctggattcacctttagcagctatgccatgagctgggtccgccaggctccagggaaggggctggagtgggtctcagttattagtggtggtggtagtagcacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31390 - protein, 121 aa, Artificial Sequence
  Description of Artificial Sequence: Synthetic polypeptide
EVQLLESGGGLIQPGGSLRLSCAASGFTFSSYAMSWVRQAPGKGLEWVSVISGGGSSTYYADSVKGRFTISRDNSKNTLYLQMNSLRAEDTAVYYCAKWRGNPTDYGMDVWGQGTTVTVSS

SEQ ID NO: 31391 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaggattcctattgtagtggtaccagctgcccctactactactactacggtatggacgtctggggccaagggaccacggtcaccgtctcctca

SEQ ID NO: 31392 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREDSYCSGTSCPYYYYYGMDVWGQGTTVTVSS

SEQ ID NO: 31393 - DNA, 363 bp, Artificial Sequence; identical to SEQ ID NO: 31327
  Description of Artificial Sequence: Synthetic polynucleotide

SEQ ID NO: 31394 - protein, 121 aa, Artificial Sequence; identical to SEQ ID NO: 31304
  Description of Artificial Sequence: Synthetic polypeptide

SEQ ID NO: 31395 - DNA, 387 bp, Artificial Sequence
  Description of Artificial Sequence: Synthetic polynucleotide
caggtgcagctggtggagtctgggggaggggtggtccagcctgggaggtccctgagactctcctgtgcagcgtctggattcaacgtcagtacctatggcatgcactgggtccgccaggctccaggcaaggggctggagtgggtggcagttatatggtatggtggaagtaataaagactatgcagactctgtgaagggccgattcaccatctccagagacagttccaagaacacgctgtatctgcaaatgaacagcctgagagccgaggacacggctgtgtattactgtgcgagagatcgggattattgtagtggtggtagttgcccttactactactactacggtatggacgtctggggccaagggaccacggtcaccgtctcctca

SEQ ID NO: 31396 - protein, 129 aa, Artificial Sequence
  Description of Artificial Sequence: Synthetic polypeptide
QVQLVESGGGVVQPGRSLRLSCAASGFNVSTYGMHWVRQAPGKGLEWVAVIWYGGSNKDYADSVKGRFTISRDSSKNTLYLQMNSLRAEDTAVYYCARDRDYCSGGSCPYYYYYGMDVWGQGTTVTVSS

SEQ ID NO: 31397 - DNA, 369 bp, Artificial Sequence
  Description of Artificial Sequence: Synthetic polynucleotide
caggtgcagctgcaggagtcgggcccaggactggtgaatccttcacagaccctgtccctcacctgcggtgtctctggtggctccatcagcagtggttattactactggagctggatccgccagcacccagggaagggcctggagtggattgggtacatctattatagtgggagcacctactacaacccgtccctcaagagtcgagtttccatatcattagacacgcctaagaaccagttctccctgaagctgacctctgtgactgccgcggacacggccgtgtattactgtgcgagagattggggtggctacgattcgagtggctggttcgacccctggggccagggaaccctggtcaccgtctcctca

SEQ ID NO: 31398 - protein, 123 aa, Artificial Sequence
  Description of Artificial Sequence: Synthetic polypeptide
QVQLQESGPGLVNPSQTLSLTCGVSGGSISSGYYYWSWIRQHPGKGLEWIGYIYYSGSTYYNPSLKSRVSISLDTPKNQFSLKLTSVTAADTAVYYCARDWGGYDSSGWFDPWGQGTLVTVSS

SEQ ID NO: 31399 - DNA, 375 bp, Artificial Sequence
  Description of Artificial Sequence: Synthetic polynucleotide
gaggtgcagctagtgcagtctggagcagaggtgaaaaagcccggggagtctctgaagatctcctgtaagggttctggatacagctttaccagctactggatcggctgggtgcgccagatgcccgggaaaggcctggagtggatggggctcatctatcctggtgcctctgataccagatacagcccgtccttccaaggccaggtcaccatctcagccgacaagtccatcagcaccgcctacctgcagtggagcagcctgaaggcctcggacaccgccatgtattactgtgcgagacaggccatagcaagtcgagggaggtactactactacggtatggacgtctggggccaagggaccacggtcaccgtctcctca

SEQ ID NO: 31400 - protein, 125 aa, Artificial Sequence
  Description of Artificial Sequence: Synthetic polypeptide
EVQLVQSGAEVKKPGESLKISCKGSGYSFTSYWIGWVRQMPGKGLEWMGLIYPGASDTRYSPSFQGQVTISADKSISTAYLQWSSLKASDTAMYYCARQAIASRGRYYYYGMDVWGQGTTVTVSS

SEQ ID NO: 31401 - DNA, 369 bp, Artificial Sequence
  Description of Artificial Sequence: Synthetic polynucleotide
caggtgcagctggtggagtctgggggaggcgtggtccagcctgggaggtccctgagactctcctgtacagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatacggagagatggctaccatactcctacggtatggacgtctggggccaagggaccacggtcaccgtctcctca

SEQ ID NO: 31402 - protein, 123 aa, Artificial Sequence
  Description of Artificial Sequence: Synthetic polypeptide
QVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCARDTERWLPYSYGMDVWGQGTTVTVSS

SEQ ID NO: 31403 - DNA, 390 bp, Artificial Sequence
  Description of Artificial Sequence: Synthetic polynucleotide
caggtgcagctggaggagtctgggggaggcgtggtccagcctgggaggtccctgagactctcctgtgcagcgtctggattcaccttcagtggctatggcatgcactgggtccgccaggctccaggcaaggggctggagtggatgacacttatacggtatgatggaagcgataaaaactatgcagactccgtgaagggccgattcaccatctccagagacaactccaagaacacgctgtatctgcaaatgaacagcctgagagccgaggacacggctgtgtattactgtgcgagagatcgggttttttgtagtagtaccagctgcctctcttactactactactacggtatggacgtctggggccaagggaccacggtcaccgtctcctca

SEQ ID NO: 31404 - protein, 130 aa, Artificial Sequence
  Description of Artificial Sequence: Synthetic polypeptide
QVQLEESGGGVVQPGRSLRLSCAASGFTFSGYGMHWVRQAPGKGLEWMTLIRYDGSDKNYADSVKGRFTISRDNSKNTLYLQMNSLRAEDTAVYYCARDRVFCSSTSCLSYYYYYGMDVWGQGTTVTVSS

SEQ ID NO: 31405 - DNA, 363 bp, Artificial Sequence; identical to SEQ ID NO: 31327
  Description of Artificial Sequence: Synthetic polynucleotide

SEQ ID NO: 31406 - protein, 121 aa, Artificial Sequence; identical to SEQ ID NO: 31304
  Description of Artificial Sequence: Synthetic polypeptide

SEQ ID NO: 31407 - DNA, 378 bp, Artificial Sequence; identical to SEQ ID NO: 31337
  Description of Artificial Sequence: Synthetic polynucleotide

SEQ ID NO: 31408 - protein, 126 aa, Artificial Sequence; identical to SEQ ID NO: 31318
  Description of Artificial Sequence: Synthetic polypeptide

SEQ ID NO: 31409 - DNA, 375 bp, Artificial Sequence
  Description of Artificial Sequence: Synthetic polynucleotide
gaggtgcagctggtggagtctgggggaggcttgatacagcctggggggtccctgagactctcctgtgcagcctctggattcaccttcagtaactataacatgaactgggtccgccaggctccagggaaggggctggagtgggtttcatacattagtagaagtagtaataccaaatactacgcagactctgtgaagggccgattcaccatctccagagacaatgccaagaactcactgtatctgcaaatgaacagcctgagagacgaggacacggctgtgtattactgtgcgagagataggagtgggagctacgggtacttctactactacggtatggacgtctggggccaagggaccacggtcaccgtctcctca

SEQ ID NO: 31410 - protein, 125 aa, Artificial Sequence
  Description of Artificial Sequence: Synthetic polypeptide
EVQLVESGGGLIQPGGSLRLSCAASGFTFSNYNMNWVRQAPGKGLEWVSYISRSSNTKYYADSVKGRFTISRDNAKNSLYLQMNSLRDEDTAVYYCARDRSGSYGYFYYYGMDVWGQGTTVTVSS

SEQ ID NO: 31411 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtagtaaatactatgcagactccgtgaagggccgattcaccatctccagagacaattccaagaacacgctgtatctgcaaatgaacagcctgagagccgaggacacggctgtgtattactgtgcgagagatcgggttttttgtagtggtaccagctgcccttactactactactacggtatggacgtctggggccaagggaccacggtcaccgtctcctca

SEQ ID NO: 31412 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSSKYYADSVKGRFTISRDNSKNTLYLQMNSLRAEDTAVYYCARDRVFCSGTSCPYYYYYGMDVWGQGTTVTVSS

SEQ ID NO: 31413 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgggtttcttgtagtagtaccagctgcccttactactactactacggtatggacgtctggggccaagggaccacggtcaccgtctcctca

SEQ ID NO: 31414 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRVSCSSTSCPYYYYYGMDVWGQGTTVTVSS

SEQ ID NO: 31415 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgggtttcttgtagtagtaccagctgcccttactactactactacggtatggacgtctggggccaagggaccacggtcaccgtctcctca

SEQ ID NO: 31416 - protein, 129 aa, Artificial Sequence
  Description of Artificial Sequence: Synthetic polypeptide
QVQLVESGGGVVQPGRSLRLSCAASGFTFSTYGMHWVRQAPGKGLEWVAVIWYDGSNKYYADSVKGRFTISRDNSKNTLYLQMNSLRAEDTAVYYCARDRVSCSSTSCPYYYYYGMDVWGQGTTVTVSS

SEQ ID NO: 31417 - DNA, 387 bp, Artificial Sequence; identical to SEQ ID NO: 31413
  Description of Artificial Sequence: Synthetic polynucleotide

SEQ ID NO: 31418 - protein, 129 aa, Artificial Sequence; identical to SEQ ID NO: 31414
  Description of Artificial Sequence: Synthetic polypeptide

SEQ ID NO: 31419 - DNA, 363 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagtcgggtatagcggtggctggtacatctttgactactggggccagggaaccctggtcaccgtctcctca

SEQ ID NO: 31420 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVGYSGGWYIFDYWGQGTLVTVSS

SEQ ID NO: 31421 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgtagactccgtgaagggccgattcaccatctccagagacaattccaagaacacgctgtatctgcaaatgaacagcctgagagccgaggacacggctgtgtattactgtgcgagagatcgggttttttgtagtggtaccagctgcccttactactactactacggtatggacgtctggggccaagggaccacggtcaccgtctcctca

SEQ ID NO: 31422 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYVDSVKGRFTISRDNSKNTLYLQMNSLRAEDTAVYYCARDRVFCSGTSCPYYYYYGMDVWGQGTTVTVSS

SEQ ID NO: 31423 - DNA, 390 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcccctactacaacccgtccctcaagagtcgaattaccatatcaatagacacgtctaagaaccagttctccctgaagctgaactctgtgactgccgcggacacggccgtgtattactgtgcgagatcgaattgtagtagtgccaactgctatacggtggggttctactactacggtttggacgtctggggccgagggaccacggtcaccgtctcctca

SEQ ID NO: 31424 - protein, 130 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSPYYNPSLKSRITISIDTSKNQFSLKLNSVTAADTAVYYCARSNCSSANCYTVGFYYYGLDVWGRGTTVTVSS

SEQ ID NO: 31425 - DNA, 390 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcccctactacaatccgtccctcaagagtcgaattaccatatcaatagacacgtctaagaaccagttctccctgaagctgaactctgtgactgccgcggacacggccgtgtattactgtgcgagatcgaattgtagtagtgccaactgctatacggtggggttctactactacggtatggacgtctggggccaagggaccacggtcaccgtctcctca

SEQ ID NO: 31426 - protein, 130 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSPYYNPSLKSRITISIDTSKNQFSLKLNSVTAADTAVYYCARSNCSSANCYTVGFYYYGMDVWGQGTTVTVSS

SEQ ID NO: 31427 - DNA, 390 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaatggctatggcatgcactgggtccgccaggctccaggcaaggggctggagtgggtggcagttatatggtatgatggaagtaataaatactatgcagactccgtgaagggccgattcaccatctccagagacacttccaagaacacgctgtttctgcaaatgaacagcctgacagccgaggacacggctgtgtattactgtgcgagagatgatagatattgtagtagtcccacctgccatccttactactactactacggtctggacgtctggggccaagggaccacggtcaccgtctcctca

SEQ ID NO: 31428 - protein, 130 aa, Artificial Sequence
  Description of Artificial Sequence: Synthetic polypeptide
QVQLVESGGGVVQPGRSLRLSCAASGFTFNGYGMHWVRQAPGKGLEWVAVIWYDGSNKYYADSVKGRFTISRDTSKNTLFLQMNSLTAEDTAVYYCARDDRYCSSPTCHPYYYYYGLDVWGQGTTVTVSS

SEQ ID NO: 31429 - DNA, 387 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcactttgagtagcaatggcatgcactgggtccgccaggctccaggcaaggggctggagtgggtggcagttatatggtatgatggaagtaataaatactatgcagactccgtgaagggccgattcaccatctccagagacacttccaagaacacgctgtatctgcaaatgaacagcctgagagccgaggacacggctgtgtattactgtgcgagagatcagtacaaccggaacgacggaccaccagcttactactactactacggtttggacgtctggggccaagggaccacggtcaccgtctcctca

SEQ ID NO: 31430 - protein, 129 aa, Artificial Sequence
  Description of Artificial Sequence: Synthetic polypeptide
QVQLVESGGGVVQPGRSLRLSCAASGFTLSSNGMHWVRQAPGKGLEWVAVIWYDGSNKYYADSVKGRFTISRDTSKNTLYLQMNSLRAEDTAVYYCARDQYNRNDGPPAYYYYYGLDVWGQGTTVTVSS

SEQ ID NO: 31431 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcactttgagcagcaatggcatgcactgggtccgccaggctccaggcaaggggctggagtgggtggcagttatatggtatgatggaagtaataaatactatgcagactccgtgaagggccgattcaccatctccagagacaattccaagaacacgctgtctctgcaaatgaacagcctgagagccgaggacacggctgtgtattactgtgcgagagatcagtacaaccggaacgacggaccaccagcttactactactactacggtatggacgtctggggccaagggaccacggtcaccgtctcctca

SEQ ID NO: 31432 - protein, 129 aa, Artificial Sequence
  Description of Artificial Sequence: Synthetic polypeptide
QVQLVESGGGVVQPGRSLRLSCAASGFTLSSNGMHWVRQAPGKGLEWVAVIWYDGSNKYYADSVKGRFTISRDNSKNTLSLQMNSLRAEDTAVYYCARDQYNRNDGPPAYYYYYGMDVWGQGTTVTVSS

SEQ ID NO: 31433 - DNA, 369 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctatagcttgaactgggtccgccaggctccagggaaggggctggagtgggtttcatacattggtagtagtggcagtatcatattctacgcagactctgtgaagggccgattcaccatctccagagacaatgccaagaactcactgtatctgcaaatgaacagcctgagagacgaggacacggctgtgtattactgtgcgagaggggatacagctggggttacctattactacggtatggacgtctggggccaagggaccacggtcaccgtctcctca

SEQ ID NO: 31434 - protein, 123 aa, Artificial Sequence
  Description of Artificial Sequence: Synthetic polypeptide
EVQLVESGGGLVQPGGSLRLSCAASGFTFSSYSLNWVRQAPGKGLEWVSYIGSSGSIIFYADSVKGRFTISRDNAKNSLYLQMNSLRDEDTAVYYCARGDTAGVTYYYGMDVWGQGTTVTVSS

SEQ ID NO: 31435 - DNA, 393 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacgggtgtgtattactgtgcgagagagggggctacgtattaccatggttcggggagttattatccggctactaactacggtatggacgtctggggccaagggaccacggtcaccgtctcctca

SEQ ID NO: 31436 - protein, 131 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSNKYYADSVKGRFTISRDNSKNTLYLQMNSLRAEDTGVYYCAREGATYYHGSGSYYPATNYGMDVWGQGTTVTVSS

SEQ ID NO: 31437 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatattatgcagactccgtgaagggccgattcaccatctccagagacaattccaagaacacgctgtatctgcaaatgaacagcctgagagccgaggacacggctgtgtattactgtgcgagtcccctttacgatatgggactctactacgatatggacgtctggggccaagggaccacggtcaccgtctcctca

SEQ ID NO: 31438 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCASPLYDMGLYYDMDVWGQGTTVTVSS

SEQ ID NO: 31439 - DNA, 390 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtggctatggcatgaactgggtccgccaggctccaggcaaggggctggagtgggtggcaattatatggtatgatggaaataataaatactatgcagactccgtgaagggccgattcaccatctccagagacaattccaagaacacgctgtatctgcaaatgaacagcctgagagccgaggacacggctgtgtattactgtgcgagagatcgggtttattgtagtagtaccagctgccatccctattactactactacgctatggacgtctggggccaagggaccacggtcaccgtctcctca

SEQ ID NO: 31440 - protein, 130 aa, Artificial Sequence
  Description of Artificial Sequence: Synthetic polypeptide
QVQLVESGGGVVQPGRSLRLSCAASGFTFSGYGMNWVRQAPGKGLEWVAIIWYDGNNKYYADSVKGRFTISRDNSKNTLYLQMNSLRAEDTAVYYCARDRVYCSSTSCHPYYYYYAMDVWGQGTTVTVSS

SEQ ID NO: 31441 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggactcaccttcagtaactgtggcatgcactgggtccgccaggctccaggcaaggggctggagtgggtggcaattatatggtatgatggaagtaataaatactatgcagactccgtgaagggccgattcaccatctccagagacaattccaagaacacgctggatctgcaaatgaacagcctgagagccgaggacacggctgtgtattactgtgcgagagatcagtacaacaggaacgacggaccaccagcttactactactactacggtttggacgtctggggccaagggaccacggtcaccgtctcctca

SEQ ID NO: 31442 - protein, 129 aa, Artificial Sequence
  Description of Artificial Sequence: Synthetic polypeptide
QVQLVESGGGVVQPGRSLRLSCAASGLTFSNCGMHWVRQAPGKGLEWVAIIWYDGSNKYYADSVKGRFTISRDNSKNTLDLQMNSLRAEDTAVYYCARDQYNRNDGPPAYYYYYGLDVWGQGTTVTVSS

SEQ ID NO: 31443 - DNA, 369 bp, Artificial Sequence; identical to SEQ ID NO: 31433
  Description of Artificial Sequence: Synthetic polynucleotide

SEQ ID NO: 31444 - protein, 123 aa, Artificial Sequence; identical to SEQ ID NO: 31434
  Description of Artificial Sequence: Synthetic polypeptide

SEQ ID NO: 31445 - DNA, 345 bp, Artificial Sequence
  Description of Artificial Sequence: Synthetic polynucleotide
caggtgcagctggtgcagtctggggctgaggtgaagaagcctggggcctcagtgaaggtttcctgcaaggcatctggatacaccttcaacagttactatatgtattgggtgcgacaggcccctggacaagggcttgagtggatgggaataatcaaccctagtggtggtagcacaaactacgcacagaagttccagggcagagtcaccatgaccagggacacgtccacgagcacactctacatggagctgaacagcctgagatctgaggacacggccgtgtattactgtgcgagtggttgggagttaaactactggggccagggaaccctggtcaccgtctcctca

SEQ ID NO: 31446 - protein, 115 aa, Artificial Sequence
  Description of Artificial Sequence: Synthetic polypeptide
QVQLVQSGAEVKKPGASVKVSCKASGYTFNSYYMYWVRQAPGQGLEWMGIINPSGGSTNYAQKFQGRVTMTRDTSTSTLYMELNSLRSEDTAVYYCASGWELNYWGQGTLVTVSS

SEQ ID NO: 31447 - DNA, 390 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcagttatatggaatgatggaggtaataaatataatggagactccgtgaagggccgattcaccatctccagagacaattccaagaacacgctgtatctgcaaatgaacagtctgagagccgaggacacggctgtgtattactgtgcgagagaccgtacgtattactctggttcggggagccccccctactactactactacggtatggacgtctggggccaagggaccacggtcaccgtctcctca

SEQ ID NO: 31448 - protein, 130 aa, Artificial Sequence
  Description of Artificial Sequence: Synthetic polypeptide
QVQLVESGGGVVQPGRSLRLSCAASGFTFSSYGMHWVRQAPGKGLEWVAVIWNDGGNKYNGDSVKGRFTISRDNSKNTLYLQMNSLRAEDTAVYYCARDRTYYSGSGSPPYYYYYGMDVWGQGTTVTVSS

SEQ ID NO: 31449 - DNA, 345 bp, Artificial Sequence
  Description of Artificial Sequence: Synthetic polynucleotide
caggtgcagctggtgcagtctggggctgaggtgaagaagcctggggcctcagtgaaggtttcctgcaaggcatctggatacaccttcagaagttactatatgtattgggtgcgacaggcccctggacaagggcttgagtgggtgggaacaatcaaccctagtggtggtagcacaaactacgcacagaagttccagggcagagtcaccatgaccagggacacgtccacgagcacactctacatggagctgaacagcctgagatctgaggacacggccgtgtattactgtgcgagtggctgggagttaaactactggggccagggaaccctggtcaccgtctcctca

SEQ ID NO: 31450 - protein, 115 aa, Artificial Sequence
  Description of Artificial Sequence: Synthetic polypeptide
QVQLVQSGAEVKKPGASVKVSCKASGYTFRSYYMYWVRQAPGQGLEWVGTINPSGGSTNYAQKFQGRVTMTRDTSTSTLYMELNSLRSEDTAVYYCASGWELNYWGQGTLVTVSS

SEQ ID NO: 31451 - DNA, 345 bp, Artificial Sequence
  Description of Artificial Sequence: Synthetic polynucleotide
caggtgcagctggtgcagtctggggctgaggtgaagaagcctggggcctcagtgacggtttcctgcaaggcatctggatacaccttcagaagttactatatgtattgggtgcgacaggcccctggacaagggcttgagtgggtgggaacaatcaaccctagtggtggtagcacagactacgcacagaagttccagggcagagtcaccatgaccagggacacgtccacgagcacactctacatggagctgaacagcctgagatctgaggacacggccgtgtattactgtgcgagtggctgggaattaaactactggggccagggaaccctggtcaccgtctcctca

SEQ ID NO: 31452 - protein, 115 aa, Artificial Sequence
  Description of Artificial Sequence: Synthetic polypeptide
QVQLVQSGAEVKKPGASVTVSCKASGYTFRSYYMYWVRQAPGQGLEWVGTINPSGGSTDYAQKFQGRVTMTRDTSTSTLYMELNSLRSEDTAVYYCASGWELNYWGQGTLVTVSS

SEQ ID NO: 31453 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggaatgggtggcagttatatcatatgatggaagtcctaaatactgtgcagactccgtgaagggccgattcaccatctccagagacaattccaagaacacgctgtttctccaaatgaacagcctgagagctgaggacacggctgtgtattattgtgcgagagatgaaaggcagtggctgccggccccctacggtatggacgtctggggccaagggaccacggtcaccgtctcctca

SEQ ID NO: 31454 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSPKYCADSVKGRFTISRDNSKNTLFLQMNSLRAEDTAVYYCARDERQWLPAPYGMDVWGQGTTVTVSS

SEQ ID NO: 31455 - DNA, 384 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgcttatccagtatctatggaaagtcgaatatccatcaacccagacacatccaagaaccagttctccctgcagctgaactctgtgactcccgaggacacggctgtttattactgtgcaagagataaggcagctgggaggaatgacttctactactacggtatggacgtctggggccaagggaccacggtcaccgtctcctca

SEQ ID NO: 31456 - protein, 128 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNAYPVSMESRISINPDTSKNQFSLQLNSVTPEDTAVYYCARDKAAGRNDFYYYGMDVWGQGTTVTVSS

SEQ ID NO: 31457 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggactcaccttcagtaactgtggcatgcactgggtccgccaggctccaggcaaggggctggagtgggtggcaattatatggtatgatggaagtaataaatactatgcagactccgtgaagggccgattcaccgtctccagagacaattccaagaacacgctggatctgcaaatgaacagcctgagagccgaggacacggctgtgtattactgtgcgagagatcagtacaacaggaacgacggaccaccagcttactactactactacggtttggacgtctggggccaagggaccacggtcaccgtctcctca

SEQ ID NO: 31458 - protein, 129 aa, Artificial Sequence
  Description of Artificial Sequence: Synthetic polypeptide
QVQLVESGGGVVQPGRSLRLSCAASGLTFSNCGMHWVRQAPGKGLEWVAIIWYDGSNKYYADSVKGRFTVSRDNSKNTLDLQMNSLRAEDTAVYYCARDQYNRNDGPPAYYYYYGLDVWGQGTTVTVSS

SEQ ID NO: 31459 - DNA, 384 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtatagtgcttatccagtatctatggaaagtcgagtatccatcaacccagacacatccaagaaccagttctccctgcagctgaactctgtgactcccgaggacacggctgtttattactgtgcaagagataaggcagctgggaggaatgacttctactactacggtatggacgtctggggccaagggaccacggtcaccgtctcctca

SEQ ID NO: 31460 - protein, 128 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYSAYPVSMESRVSINPDTSKNQFSLQLNSVTPEDTAVYYCARDKAAGRNDFYYYGMDVWGQGTTVTVSS

SEQ ID NO: 31461 - DNA, 360 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatgaatactatgcagactccgtgaagggccgattcaccatctccagagacaattccaagaacacgctgtatctgcaaatgaacagcctgagagccgaggacacggctgtgtattactgtgcgagagatatccggaactactactacggtttggacgtctggggccaagggaccacggtcaccgtctcctca

SEQ ID NO: 31462 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDIRNYYYGLDVWGQGTTVTVSS

SEQ ID NO: 31463 - DNA, 381 bp, Artificial Sequence
  Description of Artificial Sequence: Synthetic polynucleotide
caggcgcagctggtggagtctgggggaggcgtggtccagcctgggaggtccctgagactctcctgtgcagcgtctggattcaccttcagtaactctggcatgcactgggtccgccagggtccaggcaaggggctggagtgggtggcgattatatattatgatggaagttataaatacaatgcagactccgtgaagggccgattcaccatctccagagacaattccaagaacacgctgtatctgcaaatgaacagcctgagagccgaggacacggctgtatattactgtgcgagagaccgtcattacgatttccacgttccctactattactattacggtatggacgtctggggccaagggaccacggtcaccgtctcctca

SEQ ID NO: 31464 - protein, 127 aa, Artificial Sequence
  Description of Artificial Sequence: Synthetic polypeptide
QAQLVESGGGVVQPGRSLRLSCAASGFTFSNSGMHWVRQGPGKGLEWVAIIYYDGSYKYNADSVKGRFTISRDNSKNTLYLQMNSLRAEDTAVYYCARDRHYDFHVPYYYYYGMDVWGQGTTVTVSS

SEQ ID NO: 31465 - DNA, 363 bp, Artificial Sequence
  Description of Artificial Sequence: Synthetic polynucleotide
gaggtgcagctggtggagtctgggggaggcttggtacagcctggggggtccctgagattctcctgtgcagcctctggattcaccttcagtagctatagcatgaactgggtccgccaggctccagggaaggggctggagtgggttgcatacattagtagtagtggaagtaccacatactacgcagactctgtgcagggccgattcaccatctccagagacaatgccaagaactcactgtatctgcaaatgaacagcctgagagacgaggacacggctgtgtatcgctgtgcgagagatagtaggaaggggttctactacggtctggacgtctggggccaagggatcacggtcaccgtctcctca

SEQ ID NO: 31466 - protein, 121 aa, Artificial Sequence
  Description of Artificial Sequence: Synthetic polypeptide
EVQLVESGGGLVQPGGSLRFSCAASGFTFSSYSMNWVRQAPGKGLEWVAYISSSGSTTYYADSVQGRFTISRDNAKNSLYLQMNSLRDEDTAVYRCARDSRKGFYYGLDVWGQGITVTVSS

SEQ ID NO: 31467 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactttggcatgcactgggtccgccaggctccaggcaaggggctggagtgggtggcaattatatggtatgatggaagtgataaatactatgcagactccgtgaagggccgattcaccatctccagagacaattccaagaacacgctgtatctgcaaatgaacaccctgagagccgaagacacggctgtgtatttctgtgcgagaggggggcccccgttctctacggtgactatgtactttgactactggggccagggaaccctggtcaccgtctcctca

SEQ ID NO: 31468 - protein, 123 aa, Artificial Sequence
  Description of Artificial Sequence: Synthetic polypeptide
QVQLVESGGGVVQPGRSLRLSCAASGFTFSNFGMHWVRQAPGKGLEWVAIIWYDGSDKYYADSVKGRFTISRDNSKNTLYLQMNTLRAEDTAVYFCARGGPPFSTVTMYFDYWGQGTLVTVSS

SEQ ID NO: 31469 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttggattcatttcttggaatgatgataagcgctacagcccatctctgaagagcagcctcaccatcaccaaggacacctccaaaaaccaggtggttcttataatgaccaacatggaccctgtggacacagccacatattactgtgcacacaaagcagcagctgttgcttttgatatctggggccaagggacaatggtcaccgtctcttca

SEQ ID NO: 31470 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLGFISWNDDKRYSPSLKSSLTITKDTSKNQVVLIMTNMDPVDTATYYCAHKAAAVAFDIWGQGTMVTVSS

SEQ ID NO: 31471 - DNA, 390 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagggttttattactatggttcggggagtcatgtcccttaccactactactacggtttggacgtctggggccaagggaccacggtcaccgtctcctca

SEQ ID NO: 31472 - protein, 130 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGFYYYGSGSHVPYHYYYGLDVWGQGTTVTVSS

SEQ ID NO: 31473 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtatgatggaagtgataaatactatgcagactccgtgaagggccgaatcaccatctccagagacaattccaagaacacgctgtatctgcaaatgaacaccctgagagccgaagacacggctgtgtatttctgtgcgagaggggggcccccgttttctacggtgactatgtacttcgactactggggccagggaaccctggtcaccgtctcctca

SEQ ID NO: 31474 - protein, 123 aa, Artificial Sequence
  Description of Artificial Sequence: Synthetic polypeptide
QVQLVESGGGVVQPGRSLRLSCAASGFTFSNYGMHWVRQAPGKGLEWVAIIWYDGSDKYYADSVKGRITISRDNSKNTLYLQMNTLRAEDTAVYFCARGGPPFSTVTMYFDYWGQGTLVTVSS

SEQ ID NO: 31475 - DNA, 366 bp, Artificial Sequence
  Description of Artificial Sequence: Synthetic polynucleotide
caggttcagctggtgcagtctggagctgaggtgaagaagcctggggcctcagtgaaggtctcctgcaaggcttctggttacacctttaacagctatggtatcagctgggtgcgacaggcccctggacaagggcttgagtggatgggatggatcagcgcttataatggtaacacaaagtatgcacagaagctccagggcagagtcaccatgaccacagacacatccacgagcacagcctacatggagctgaggagcctgagatctgacgacacggccgtgtattactgtgcgagacacgatttttggagtggttattataagggtatggacgtctggggccaagggaccacggtcaccgtctcctca

SEQ ID NO: 31476 - protein, 122 aa, Artificial Sequence
  Description of Artificial Sequence: Synthetic polypeptide
QVQLVQSGAEVKKPGASVKVSCKASGYTFNSYGISWVRQAPGQGLEWMGWISAYNGNTKYAQKLQGRVTMTTDTSTSTAYMELRSLRSDDTAVYYCARHDFWSGYYKGMDVWGQGTTVTVSS

SEQ ID NO: 31477 - DNA, 378 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagtaacagtgctgcttggaactggatcaggcagtccccatcgagaggccttgagtggctgggaaggacatactacaggtccaagtggtataatgattatgcagtatctgtgaaaagtcgaataaccttcaacccggacacatccaagaaccagttctccctgcggctgaactctgtgactcccgaggacacggctgtgtattactgtgcaagagaccgctataactggaactacccctactggtacttcgatctctggggccgtggcaccctggtcactgtctcctca

SEQ ID NO: 31478 - protein, 126 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITFNPDTSKNQFSLRLNSVTPEDTAVYYCARDRYNWNYPYWYFDLWGRGTLVTVSS

SEQ ID NO: 31479 - DNA, 366 bp, Artificial Sequence
  Description of Artificial Sequence: Synthetic polynucleotide
caggttcagctggtgcagtctggagctgaggtgaagaagcctggggcctcagtgaaggtctcctgcaaggcttctggttacacctttaacagctatggtgtcagctgggtgcgacaggcccctggacaagggcttgagtggatgggatggatcagcgcttataatggtaacagaaagtatgcacagaagctccagggcagagtctccatgaccacagacacatccacgagcacagcctacatggagctgaggagcctgagatctgacgacacggccgtgtattactgtgcgagacacgatttttggagtggttattataagggtatggacgtctggggccaagggaccacggtcaccgtctcctca

SEQ ID NO: 31480 - protein, 122 aa, Artificial Sequence
  Description of Artificial Sequence: Synthetic polypeptide
QVQLVQSGAEVKKPGASVKVSCKASGYTFNSYGVSWVRQAPGQGLEWMGWISAYNGNRKYAQKLQGRVSMTTDTSTSTAYMELRSLRSDDTAVYYCARHDFWSGYYKGMDVWGQGTTVTVSS

SEQ ID NO: 31481 - DNA, 390 bp, Artificial Sequence
  Description of Artificial Sequence: Synthetic polynucleotide
caggtgcagctggtggagtctgggggaggcgtggtccagcccgggaggtccctgagactctcctgtgcagcgtctggattcaccttcagtggctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtttattactgtgcgagagatcgggtctattgtagtagttccagctgctcatattactactactactacggtatggacgtctggggccaagggaccacggtcaccgtctcctca

SEQ ID NO: 31482 - protein, 130 aa, Artificial Sequence
  Description of Artificial Sequence: Synthetic polypeptide
QVQLVESGGGVVQPGRSLRLSCAASGFTFSGYGMHWVRQAPGKGLEWVAVIWYDGSNKYYADSVKGRFTISRDNSKNTLYLQMNSLRAEDTAVYYCARDRVYCSSSSCSYYYYYYGMDVWGQGTTVTVSS

SEQ ID NO: 31483 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactttggcatgcactgggtccgccaggctccaggcaaggggctgaaatgggtggcagttatttggtatgatggaagtaataaatactatgcagactccgtgaagggccgattcaccatctccagagacaattccaagaacacgctgtatctgcaaatgaacagcctgagagccgaggacacggctgtgtattactgtgcgagaggggactggaactacgagggttttgactactggggccagggaaccctggtcaccgtctcctca

SEQ ID NO: 31484 - protein, 119 aa, Artificial Sequence
  Description of Artificial Sequence: Synthetic polypeptide
QVQLVESGGGVVQPGRSLRLSCAASGFTFSHFGMHWVRQAPGKGLKWVAVIWYDGSNKYYADSVKGRFTISRDNSKNTLYLQMNSLRAEDTAVYYCARGDWNYEGFDYWGQGTLVTVSS

SEQ ID NO: 31485 - DNA, 366 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggaaacaccttcaccggctactatatgcactgggtgcgacaggcccctggacaagggcttgagtggatgggatggatcatccctaacagtggtgacacaaactatgcacagaagtttcagggcagggtcaccatgaccagggacacgtccatcagcacagcctacatggagctgagcaggctgagatctgacgacacggccgtctattactgtgcgagagatgggtatagcagtggctggttcaactggttcgacccctggggccagggaaccctggtcaccgtctcctca

SEQ ID NO: 31486 - protein, 122 aa, Artificial Sequence
  Description of Artificial Sequence: Synthetic polypeptide
QVQLVQSGAEVKKPGASVKVSCKASGNTFTGYYMHWVRQAPGQGLEWMGWIIPNSGDTNYAQKFQGRVTMTRDTSISTAYMELSRLRSDDTAVYYCARDGYSSGWFNWFDPWGQGTLVTVSS

SEQ ID NO: 31487 - DNA, 366 bp, Artificial Sequence
  Description of Artificial Sequence: Synthetic polynucleotide
caggttcagctggtgcagtctggagctgaggtgaagaagcctggggcctcagtgaaggtctcctgcaaggcttctggttacacctttaacagctatggtatcagctgggtgcgactggcccctggacaagggcttgagtggatgggatggattagtgcttataatggtaacacaaagaatgcacagaagctccagggcagagtcaccatgaccacagacacatccacgagcacagcctacatggagctgaggagcctgagatctgacgacacggccgtttattactgtgcgagacacgatttttggagtggttattataagggtatggacgtctggggccaagggaccacggtcaccgtctcctca

SEQ ID NO: 31488 - protein, 122 aa, Artificial Sequence
  Description of Artificial Sequence: Synthetic polypeptide
QVQLVQSGAEVKKPGASVKVSCKASGYTFNSYGISWVRLAPGQGLEWMGWISAYNGNTKNAQKLQGRVTMTTDTSTSTAYMELRSLRSDDTAVYYCARHDFWSGYYKGMDVWGQGTTVTVSS

SEQ ID NO: 31489 - DNA, 366 bp, Artificial Sequence
  Description of Artificial Sequence: Synthetic polynucleotide
caggttcagctggtgcagtctggagctgaggtgaagaagcctggggcctcagtgaaggtctcctgcaaggcttctggctacacctttaacagctatggtatcagctgggtgcgacaggcccctggacaagggcttgagtggatgggatggatcagcgcttataatggtaacacaaagtatgcacagaagttccagggcagagtcaccatgaccacagacacatccacgagcacagcctacatggagctgaggagcctgagatctgacgacacggccgtgtattactgtgcgagacacgatttttggagtggttattataagggtatggacgtctggggccaagggaccacggtcaccgtctcctca

SEQ ID NO: 31490 - protein, 122 aa, Artificial Sequence
  Description of Artificial Sequence: Synthetic polypeptide
QVQLVQSGAEVKKPGASVKVSCKASGYTFNSYGISWVRQAPGQGLEWMGWISAYNGNTKYAQKFQGRVTMTTDTSTSTAYMELRSLRSDDTAVYYCARHDFWSGYYKGMDVWGQGTTVTVSS

SEQ ID NO: 31491 - DNA, 366 bp, Artificial Sequence
  Description of Artificial Sequence: Synthetic polynucleotide
caggttcaactggtgcagtctggagctgaggtgaagaagcctggggcctcagtgaaggtctcctgcaaggcttctggttacacctttaacagctatggtttcagctgggtgcgacaggcccctggacaagggcttgagtggatgggatggatcagcgcttataatggtaacacaaaggaagcacagaagttccagggcagagtcaccatgaccacagacacatccacgagcacagcctacatggagctgaggagcctgagagctgacgacacggccgtgtattactgtgcgagacacgatttttggagtggttattataagggtatggacgtctggggccaagggaccacggtcaccgtctcctca

SEQ ID NO: 31492 - protein, 122 aa, Artificial Sequence
  Description of Artificial Sequence: Synthetic polypeptide
QVQLVQSGAEVKKPGASVKVSCKASGYTFNSYGFSWVRQAPGQGLEWMGWISAYNGNTKEAQKFQGRVTMTTDTSTSTAYMELRSLRADDTAVYYCARHDFWSGYYKGMDVWGQGTTVTVSS

SEQ ID NO: 31493 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagtactagtggagtgggtgtgggctggatccgtcagcccccaggaaaggccctggagtggcttgcactcatttattggcatgaagataagcgctacagcccatctctgaagagcaggctcaccatcactgaggacacctccaaaaaccaggtggaccttacaatgaccaacatggcccctgtggacacagccacatattactgtgcacacgtcacaggtatagcagctccctactggggccagggaaccctggtcaccgtctcctca

SEQ ID NO: 31494 - protein, 118 aa, Artificial Sequence
  Description of Artificial Sequence: Synthetic polypeptide
QITLKESGPTLVKPTQTLTLTCTFSGFSLSTSGVGVGWIRQPPGKALEWLALIYWHEDKRYSPSLKSRLTITEDTSKNQVDLTMTNMAPVDTATYYCAHVTGIAAPYWGQGTLVTVSS

SEQ ID NO: 31495 - DNA, 354 bp, Artificial Sequence
  Description of Artificial Sequence: Synthetic polynucleotide
cagatcaccttgaaggagtctggtcctatgctggtgaaacccacacagaccctcacgctgacctgcaccttctctgggttctcactcagcactagtggagtgggtgtgggctggatccgtcagcccccaggaaaggccctggagtggcttgcactcatttattggaatgatgataagcgctacagtccatctctgaagagcaggctcaccatcaccgaggacacctccaaaaaccaggtggtccttacaatgaccaacatggaccctgtggacacagccacatattactgtgcacatgcagtggctgtctcctttgactactggggccagggaaccctggtcaccgtctcctca

SEQ ID NO: 31496 - protein, 118 aa, Artificial Sequence
  Description of Artificial Sequence: Synthetic polypeptide
QITLKESGPMLVKPTQTLTLTCTFSGFSLSTSGVGVGWIRQPPGKALEWLALIYWNDDKRYSPSLKSRLTITEDTSKNQVVLTMTNMDPVDTATYYCAHAVAVSFDYWGQGTLVTVSS

SEQ ID NO: 31497 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcactactagtggagtgggtgtgggctggatccgtcagcccccaggaaaggccctggagtggcttgcactcatttattggcatgaagataggcgctacagcccatctctgaagagcaggctcaccatcactgaggacacctccaaaaaccaggtggaccttacaatgaccaacatggcccctgtggacacagccacatattactgtgcacacgtcacaggtatagcagctccctactggggccagggaaccctggtcaccgtctcctca

SEQ ID NO: 31498 - protein, 118 aa, Artificial Sequence
  Description of Artificial Sequence: Synthetic polypeptide
QITLKESGPTLVKPTQTLTLTCTFSGFSLTTSGVGVGWIRQPPGKALEWLALIYWHEDRRYSPSLKSRLTITEDTSKNQVDLTMTNMAPVDTATYYCAHVTGIAAPYWGQGTLVTVSS

SEQ ID NO: 31499 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccgaggacacctccaaaaaccaggtggtccttacaatgaccaacatggaccctgtggacacagccacatattactgtgcacaccttatagcagtggcctttgactcctggggccagggaaccctggtcaccgtctcctca

SEQ ID NO: 31500 - protein, 118 aa, Artificial Sequence
  Description of Artificial Sequence: Synthetic polypeptide
QITLKESGPTLVKPTQTLTLTCTFSGFSLSTSGVGVGWIRQPPGKALEWLALIYWDDDKRYSPSLKSRLTITEDTSKNQVVLTMTNMDPVDTATYYCAHLIAVAFDSWGQGTLVTVSS

SEQ ID NO: 31501 - DNA, 351 bp, Artificial Sequence
  Description of Artificial Sequence: Synthetic polynucleotide
gaggtgcagttggtggagtctgggggaggcctggtcaagcctggggggtccctgagactctcctgtgcagcctctggattcaccttcaatagctatagcatgaactgggtccgccaggctccagggaaggggctggagtggatctcatccattagtagtagtagttattacttatactacgcagactcagtgaagggccgattcaccatctccagagacagcgccaagaattcactgtatctgcaaatgaacagcctgagagccgaggacacggctgtatattactgtgcgaggacctatagtgggagttttgactactggggccagggaaccctggtcaccgtctcctca

SEQ ID NO: 31502 - protein, 117 aa, Artificial Sequence
  Description of Artificial Sequence: Synthetic polypeptide
EVQLVESGGGLVKPGGSLRLSCAASGFTFNSYSMNWVRQAPGKGLEWISSISSSSYYLYYADSVKGRFTISRDSAKNSLYLQMNSLRAEDTAVYYCARTYSGSFDYWGQGTLVTVSS

SEQ ID NO: 31503 - DNA, 372 bp, Artificial Sequence
  Description of Artificial Sequence: Synthetic polynucleotide
caggtgcagttggtggagtctgggggaggcgtggtccagcctgggaggtccctgagactctcctgtgcagcctctggattcaccttcagtttctatggcatgcactgggtccgccaggctccaggcaaggggctggagtgggtggcagttacatcatatgatggaagtgataaatactatgcagactccgtgaagggccgattctccatctccagagacaattccaagaacacgctgtatctgcaaatgagcagcctgagagctgaggacacggctatgtattactgtgcgagagatgactatggttcggggagtcccctatactacggtatggacgtctggggccaagggaccacggtcaccgtctcctca

SEQ ID NO: 31504 - protein, 124 aa, Artificial Sequence
  Description of Artificial Sequence: Synthetic polypeptide
QVQLVESGGGVVQPGRSLRLSCAASGFTFSFYGMHWVRQAPGKGLEWVAVTSYDGSDKYYADSVKGRFSISRDNSKNTLYLQMSSLRAEDTAMYYCARDDYGSGSPLYYGMDVWGQGTTVTVSS

SEQ ID NO: 31505 - DNA, 372 bp, Artificial Sequence
  Description of Artificial Sequence: Synthetic polynucleotide
gaggtgcagctggtggagtctgggggaggcttggtccagcctggggggtccctgagactctcctgtgcagcctctggattcacctttagtagcttttggatgagctgggtccgccaggctccagggaaggggctggagtgggtggcccacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaggggacctcccatacagctcgggctactactacggtatggacgtctggggccaagggaccacggtcaccgtctcctca

SEQ ID NO: 31506 - protein, 124 aa, Artificial Sequence
  Description of Artificial Sequence: Synthetic polypeptide
EVQLVESGGGLVQPGGSLRLSCAASGFTFSSFWMSWVRQAPGKGLEWVAHIKQDGSEKYYVDSVKGRFTISRDNAKNSLYLQMNSLRAEDTAVYYCARGDLPYSSGYYYGMDVWGQGTTVTVSS

SEQ ID NO: 31507 - DNA, 393 bp, Artificial Sequence
  Description of Artificial Sequence: Synthetic polynucleotide
caggtgcaactggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgttgtatctgcaaatgaacagcctgagagctgaggacacggctgtgtattactgtgcgagagatgagggacgtggatatggtggctacgagaggggatattactactactactacggtatggacgtctggggccaagggaccacggtcaccgtctcctca

SEQ ID NO: 31508 - protein, 131 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDEGRGYGGYERGYYYYYYGMDVWGQGTTVTVSS

SEQ ID NO: 31509 - DNA, 369 bp, Artificial Sequence
  Description of Artificial Sequence: Synthetic polynucleotide
gaggtgcagctggtggaatctgggggaggcttggtacagcctggggggtccctgagactctcctgtgcagcctctggattcaccttcagtagctatagcatgaactgggtccgccaggctccagggaaggggctggagtggatttcatacattagtactagtagtagtaccatattctacgcagactctgtgaagggccgattcaccatctccagagacagtgccaagaactcactgtatctgcaaatgaacagcctgagagacgaggacacggctgtgtattactgtgcgaggggggatacagctatggtcctctactactacggtatggacgtctggggccaagggaccacggtcaccgtctcctca

SEQ ID NO: 31510 - protein, 123 aa, Artificial Sequence
  Description of Artificial Sequence: Synthetic polypeptide
EVQLVESGGGLVQPGGSLRLSCAASGFTFSSYSMNWVRQAPGKGLEWISYISTSSSTIFYADSVKGRFTISRDSAKNSLYLQMNSLRDEDTAVYYCARGDTAMVLYYYGMDVWGQGTTVTVSS

SEQ ID NO: 31511 - DNA, 369 bp, Artificial Sequence
  Description of Artificial Sequence: Synthetic polynucleotide
gaggtgcagctggtggagtctgggggaggcttggtacagcctggggggtccctgagactctcctgtggagcctctggattcaccttcagtagctatagcatgaactgggtccgccaggctccagggaagggactggagtgggtttcatacattagtgggagtagtaatatcatatactacacagactctgtgaagggccgattcaccatctccagagacaatgccaagaactcactgtatctgcaaatgaacagcctgagagacgaggacacggctgtgtattactgtgcgagagcggatacacctatggtcctttacttctacggtatggacgtctggggccaagggaccacggtcaccgtctcctca

SEQ ID NO: 31512 - protein, 123 aa, Artificial Sequence
  Description of Artificial Sequence: Synthetic polypeptide
EVQLVESGGGLVQPGGSLRLSCGASGFTFSSYSMNWVRQAPGKGLEWVSYISGSSNIIYYTDSVKGRFTISRDNAKNSLYLQMNSLRDEDTAVYYCARADTPMVLYFYGMDVWGQGTTVTVSS

SEQ ID NO: 31513 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagttatggcgtgcactgggtccgccaggctccaggcaaggggctggagtgggtggcagctatatggtatgatggaagtaataaatactatgcagactccgtgaagggccgattcaccatctccagagacaattccaagaacacgctgtatctgctaatgaacagcctgagagccgaggacacggctgtgtattactgtgcgagagatagggactattgtagtagttccagctgcccttactactactactacggtatggacgtctggggccaagggaccacggtcaccgtctcctca

SEQ ID NO: 31514 - protein, 129 aa, Artificial Sequence
  Description of Artificial Sequence: Synthetic polypeptide
QVQLVESGGGVVQPGRSLRLSCAASGFTFSSYGVHWVRQAPGKGLEWVAAIWYDGSNKYYADSVKGRFTISRDNSKNTLYLLMNSLRAEDTAVYYCARDRDYCSSSSCPYYYYYGMDVWGQGTTVTVSS

SEQ ID NO: 31515 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagtactagtggagtgggtgtgggctggatccgtcagcccccaggaaaggccctggagtggcttgcactcatttattggcatgaagataagcgctacagcccatctctgaagagcaggctcaccatcactgaggacacctccaaaaaccaggtggaccttacaatgaccaacatggcccctgtggacacagccacatattactgtgcacacgtcacatatatagcagctccctactggggccagggaaccctggtcaccgtctcctca

SEQ ID NO: 31516 - protein, 118 aa, Artificial Sequence
  Description of Artificial Sequence: Synthetic polypeptide
QITLKESGPTLVKPTQTLTLTCTFSGFSLSTSGVGVGWIRQPPGKALEWLALIYWHEDKRYSPSLKSRLTITEDTSKNQVDLTMTNMAPVDTATYYCAHVTYIAAPYWGQGTLVTVSS

SEQ ID NO: 31517 - DNA, 369 bp, Artificial Sequence
  Description of Artificial Sequence: Synthetic polynucleotide
gaggtgcagctggtggagtctgggggaggcttggtacagcctggggggtccctgagactctcctgtggagcctctggattcaccttcagtagctatagcatgaactgggtccgccaggctccaggaaagggactggagtgggtttcatacattagtgagagtagtaatatcatatactacacagactctgtgaagggccgattcaccatctccagagacaatgccatgaactcactgtatctgcaaatgaacagcctgagagacgaggacacggctgtgtattactgtgcgagagcggatacacctatggtcctttacttctacggtatggacgtctggggccaagggaccacggtcaccgtctcctca

SEQ ID NO: 31518 - protein, 123 aa, Artificial Sequence
  Description of Artificial Sequence: Synthetic polypeptide
EVQLVESGGGLVQPGGSLRLSCGASGFTFSSYSMNWVRQAPGKGLEWVSYISESSNIIYYTDSVKGRFTISRDNAMNSLYLQMNSLRDEDTAVYYCARADTPMVLYFYGMDVWGQGTTVTVSS

SEQ ID NO: 31519 - DNA, 354 bp, Artificial Sequence; identical to SEQ ID NO: 31499
  Description of Artificial Sequence: Synthetic polynucleotide

SEQ ID NO: 31520 - protein, 118 aa, Artificial Sequence; identical to SEQ ID NO: 31500
  Description of Artificial Sequence: Synthetic polypeptide

SEQ ID NO: 31521 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagtactagtgggttgggtgtgggctggatccgtcagcccccaggaaaggccctggagtggcttgcactcatttattcacatgaagataagcgctacagcccatctctgaagagcaggctcaccatcactgaggacacctccaaaaaccaggtggaccttacaatgaccaacatggcccctgtggacacagccacatattactgtgcacacgtcacaggtatagcagctccctactggggccagggaaccctggtcaccgtctcctca

SEQ ID NO: 31522 - protein, 118 aa, Artificial Sequence
  Description of Artificial Sequence: Synthetic polypeptide
QITLKESGPTLVKPTQTLTLTCTFSGFSLSTSGLGVGWIRQPPGKALEWLALIYSHEDKRYSPSLKSRLTITEDTSKNQVDLTMTNMAPVDTATYYCAHVTGIAAPYWGQGTLVTVSS

SEQ ID NO: 31523 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcgctcagcactagtggagtgggtgtgggctggatccgtcagcccccaggaaaggccctggagtggcttgcactcattaattggaatgatgataagcgctacagcccatctctgaagagcaggttcaccatcaccagggacacctccaaagaccaggtggtccttacaatgaccaacatggaccctgtggacacagccacatattactgtgcacataaagctacctgggtggcttttgatatctggggccaagggacaatggtcaccgtctcttca

SEQ ID NO: 31524 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLALINWNDDKRYSPSLKSRFTITRDTSKDQVVLTMTNMDPVDTATYYCAHKATWVAFDIWGQGTMVTVSS

SEQ ID NO: 31525 - DNA, 357 bp, Artificial Sequence
  Description of Artificial Sequence: Synthetic polynucleotide
cagatcaccttgaaggagtctggtcctacgctggtgaaacccacacagaccctcacgctgacctgtaccttctctgggttctcactcagcactagtggagtgggtgtgggctggatccgtcagcccccaggaaaggccctggagtggcttgcactcattaattggaatgatgataagcgctacagcccatctctgaagagcaggttcaccatcaccagggacacctccaaagaccaggtggtccttacaatgaccaacatggaccctgtggacacagccacatattactgtgcacataaagctacctgggtggcttttgatatctggggccaagggacaatggtcaccgtctcttca

SEQ ID NO: 31526 - protein, 119 aa, Artificial Sequence; identical to SEQ ID NO: 31524
  Description of Artificial Sequence: Synthetic polypeptide

SEQ ID NO: 31527 - DNA, 357 bp, Artificial Sequence
  Description of Artificial Sequence: Synthetic polynucleotide
cagatcaccttgaaggagtctggtcctacgctggtgaaatccacacagaccctcacgctgacctgcaccttctctgggttctcactcagcactagtggagtgggtgtgggctggatccgtcagcccccaggaaaggccctggagtggcttgcactcattaattggaatgatgataagcgctacagcccatctctgaagagcaggttcaccatcaccagggacacctccaaagaccaggtggtccttacaatgaccaacatggaccctgtggacacagccacatattactgtgcacataaagctacctgggtggcttttgatatctggggccaagggacaatggtcaccgtctcttca

SEQ ID NO: 31528 - protein, 119 aa, Artificial Sequence
  Description of Artificial Sequence: Synthetic polypeptide
QITLKESGPTLVKSTQTLTLTCTFSGFSLSTSGVGVGWIRQPPGKALEWLALINWNDDKRYSPSLKSRFTITRDTSKDQVVLTMTNMDPVDTATYYCAHKATWVAFDIWGQGTMVTVSS

SEQ ID NO: 31529 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcattaattggaatgatgataaacgctacagcccatctctgaagagcaggttcaccatcaccagggacacctccaaagaccaggtggtccttacaatgaccaacatggaccctctggacacagccacatattactgtgcacataaaactacctgggtggcttttgatatctggggccaagggacaatggtcaccgtctcttca

SEQ ID NO: 31530 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLALINWNDDKRYSPSLKSRFTITRDTSKDQVVLTMTNMDPLDTATYYCAHKTTWVAFDIWGQGTMVTVSS

SEQ ID NO: 31531 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcaacactagtggagtgggtgtgggctggatccgtcagcccccaggaaaggccctggagtggcttgcactcattaattggaatgatgataagcgctacagcccgtctctgaagagcaggttcaccatcaccagggacacctccaaagaccaggtggtccttacaatgaccaacatggaccctgtggacacagccacatattactgtgcacataaagctacctgggtggcttttgatatctggggccaagggacaatggtcaccgtctcttca

SEQ ID NO: 31532 - protein, 119 aa, Artificial Sequence
  Description of Artificial Sequence: Synthetic polypeptide
QITLKESGPTLVKPTQTLTLTCTFSGFSLNTSGVGVGWIRQPPGKALEWLALINWNDDKRYSPSLKSRFTITRDTSKDQVVLTMTNMDPVDTATYYCAHKATWVAFDIWGQGTMVTVSS

SEQ ID NO: 31533 - DNA, 378 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctatagcatgaactgggtccgccaggctccggggaaggggctggagtgggtttcatacattagtagtagtactagtaccatatactacgcagcctctgtgaagggccgattcaccatctccagagacaatgccaagaactcactgtatctgcaaatgaacagcctgagagacgaggacacggctgtgtattactgtgcgagagatcaccgttactatgatagtagtggttattactctgatgcttttgatatctggggccaagggacaatggtcaccgtctcttca

SEQ ID NO: 31534 - protein, 126 aa, Artificial Sequence
  Description of Artificial Sequence: Synthetic polypeptide
EVQLVESGGGLVQPGGSLRLSCAASGFTFSSYSMNWVRQAPGKGLEWVSYISSSTSTIYYAASVKGRFTISRDNAKNSLYLQMNSLRDEDTAVYYCARDHRYYDSSGYYSDAFDIWGQGTMVTVSS

SEQ ID NO: 31535 - DNA, 378 bp, Artificial Sequence
  Description of Artificial Sequence: Synthetic polynucleotide
gaggtgcagctggtggagtctgggggaggcttggtacagcctggggggtccctgagactctcctgtgcagcctctggattcaccttcagtagctatagcatgaactgggtccgccaggctccggggaaggggctggagtgggtttcatacattagtagtagtactagtaccatatactacgcagcctctgtgaagggccgattcaccatctccagagacaatgccaagaattcactgtatctgcaaatgaacagcctgagagacgaggacacggctgtgtattactgtgcgagagatcaccgttactatgatagtagtggttattactctgatgcttttgatatctggggccaagggacaatggtcaccgtctcttca

SEQ ID NO: 31536 - protein, 126 aa, Artificial Sequence; identical to SEQ ID NO: 31534
  Description of Artificial Sequence: Synthetic polypeptide

SEQ ID NO: 31537 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaattatgcacagaagtttcagggcagggtcaccatgaccagggacacgtccatcagcacagcctacatggagctgagcaggctgagatctgacgacacggccgtgtattactgtgcgagagcgtattattatggttcggggagttattataatgaatttgatatgtggggccaagggacaatggtcaccgtctcttca

SEQ ID NO: 31538 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARAYYYGSGSYYNEFDMWGQGTMVTVSS

SEQ ID NO: 31539 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcattaattggaatgatgataagcgcttcagcccatctctgaagagcaggttcaccatcaccagggacacctccaaagaccaggtggtccttacaatgaccaacatggaccctgtggacacagccacatattactgtgcacataaagctacctgggtggcttttgatatctggggccaagggacaatggtcaccgtctcttca

SEQ ID NO: 31540 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLALINWNDDKRFSPSLKSRFTITRDTSKDQVVLTMTNMDPVDTATYYCAHKATWVAFDIWGQGTMVTVSS

SEQ ID NO: 31541 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatggacagaagtttcagggcagggtcaccatgaccagggacacgtccatcagcacagcctacatggagctgagcaggctgagatctgacgacacggccgtatattactgtgcgagaacgtatttctatggttcggggagttattataacggctttgactactggggccagggaaccctggtcaccgtctcctca

SEQ ID NO: 31542 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYGQKFQGRVTMTRDTSISTAYMELSRLRSDDTAVYYCARTYFYGSGSYYNGFDYWGQGTLVTVSS

SEQ ID NO: 31543 - DNA, 372 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccgagtgctataatgattatgcagtatctgtgcagagtcgaataaccatcaacccagacacatccaagaaccagttctccctgcacctgaactctgtgactcccgaggacacggctgtgtatttctgtgcaagagatagagggcatagagggttctacggtatggacgtctggggccaagggaccacggtcaccgtctcctca

SEQ ID NO: 31544 - protein, 124 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSECYNDYAVSVQSRITINPDTSKNQFSLHLNSVTPEDTAVYFCARDRGHRGFYGMDVWGQGTTVTVSS

SEQ ID NO: 31545 - DNA, 372 bp, Artificial Sequence
  Description of Artificial Sequence: Synthetic polynucleotide
caggtgcagatggtgcagtctggggatgaggtgaagaagcctggggcctcagtgaaggtctcgtgcaaggcttcgggatacaccttcaccggctaccatatgcactgggtgcgacaggcccctggacaagggcttgagtggatgggatggatcaaccctaacagtggtggcacaaattatgcacagaagtttcagggcagggtcaccatgaccagggacacgtccatcagcacagcctacatggagctgagcaggatgagatctgacgacacggccgtgtattactgtgcgagagcgtattattatggttcggggagttattataatgaatctgatatgtggggccaagggacaatggtcaccgtctcttca

SEQ ID NO: 31546 - protein, 124 aa, Artificial Sequence
  Description of Artificial Sequence: Synthetic polypeptide
QVQMVQSGDEVKKPGASVKVSCKASGYTFTGYHMHWVRQAPGQGLEWMGWINPNSGGTNYAQKFQGRVTMTRDTSISTAYMELSRMRSDDTAVYYCARAYYYGSGSYYNESDMWGQGTMVTVSS

SEQ ID NO: 31547 - DNA, 372 bp, Artificial Sequence
  Description of Artificial Sequence: Synthetic polynucleotide
caggtgcagctggtgcagtccggggctgaggtgaagaagcctggggcctcagtgagggtctcctgcaaggcttctggatacaccttcaccggctactatatgcactgggtgcgacaggcccctggacaagggcttgagtggatgggatggatcaaccctaacagtggtggcacaaactatggacagaagtttcaggacagggtcaccatgaccagggacacgtccatcagcacagccttcatggagctgagcaggctgagatctgacgacacggccgcatattactgtgcgagaacgtattactatgggtcggggagttattataacggctttgactactggggccagggaaccctggtcaccgtctcctca

SEQ ID NO: 31548 - protein, 124 aa, Artificial Sequence
  Description of Artificial Sequence: Synthetic polypeptide
QVQLVQSGAEVKKPGASVRVSCKASGYTFTGYYMHWVRQAPGQGLEWMGWINPNSGGTNYGQKFQDRVTMTRDTSISTAFMELSRLRSDDTAAYYCARTYYYGSGSYYNGFDYWGQGTLVTVSS

SEQ ID NO: 31549 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactgtatgcactgggtgcgacaggcccctggacaagggcttgagtggatgggatggatcaaccctaacagtggtggcacaaactatgcacagaagtttcaggtcagggtcaccatgaccagggacacgtccgtcagcacagtctacatggacctgagcaggctgagatctgacgacacggccgtgtattactgtgcgagagcgtattactatggttcggggacttatcataacgaatttgactactggggccagggaagtttggtcaccgtctcctca

SEQ ID NO: 31550 - protein, 124 aa, Artificial Sequence
  Description of Artificial Sequence: Synthetic polypeptide
QVQLVQSGAEVKKPGASVKVSCKASGYTFTGYCMHWVRQAPGQGLEWMGWINPNSGGTNYAQKFQVRVTMTRDTSVSTVYMDLSRLRSDDTAVYYCARAYYYGSGTYHNEFDYWGQGSLVTVSS

SEQ ID NO: 31551 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatggacagaagtttcagggcagggtcaccatgaccagggacacgtccatcagcacagcctacatggagctgagcaggctgagatctgacgacacggccgtatattactgtgcgagaacgtattactatggttcggggagttattataacggctttgactactggggccagggaaccctggtcaccgtctcctca

SEQ ID NO: 31552 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYGQKFQGRVTMTRDTSISTAYMELSRLRSDDTAVYYCARTYYYGSGSYYNGFDYWGQGTLVTVSS

SEQ ID NO: 31553 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcattaattggaatgatgataagcgctacagcccatctctgaagagcaggttcaccatcaccagggacacctccaaagaccaggtggtctttacaatgaccaacatggaccctgtggacacaggcacatattactgtgcacataaagctacctgggtggcttttgatatctggggccaagggacaatggtcaccgtctcttca

SEQ ID NO: 31554 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLALINWNDDKRYSPSLKSRFTITRDTSKDQVVFTMTNMDPVDTGTYYCAHKATWVAFDIWGQGTMVTVSS

SEQ ID NO: 31555 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcaggcactggattcaccttcagttactatggcatgcactgggtccgccaggctccaggcaaggggctggagtgggtggcagttacaacatatgatggaagtaataaatactatgcagactccgtgaagggccgattcaccagctccagagacaattccaagaacacgctgtatctgcaaatgaatagcctgagagctgaggacacggctgtgtatcactgtgcgagagagactggaacctgggcttttgatatctggggccaagggacaatggtcaccgtctcttta

SEQ ID NO: 31556 - protein, 118 aa, Artificial Sequence
  Description of Artificial Sequence: Synthetic polypeptide
QVQLVESGGGVVQPGRSLRLSCAGTGFTFSYYGMHWVRQAPGKGLEWVAVTTYDGSNKYYADSVKGRFTSSRDNSKNTLYLQMNSLRAEDTAVYHCARETGTWAFDIWGQGTMVTVSL

SEQ ID NO: 31557 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcattaattggaatgatgataagcgctacagcccatctctgaagagcaggttcaccatcaccagggacacctccaaagaccaggtggtccttacaatgaccaacatggaccctgtggacacagccacatattactgtgcacataaaactacctgggtggcttttgatatctggggccaagggacaatggtcaccgtctcttca

SEQ ID NO: 31558 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLALINWNDDKRYSPSLKSRFTITRDTSKDQVVLTMTNMDPVDTATYYCAHKTTWVAFDIWGQGTMVTVSS

SEQ ID NO: 31559 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactggtggagtgggtgtgggctggatccgtcagcccccaggaaaggccctggagtggcttgcactcatttattgggatgatgataagcgctacagcccatctctgaagagcaggctcaccatcaccaaggacacccccaaaaaccaggtggtccttacaatgaccaacatggaccctgtggacacagccacatattactgtgcacaccttatagcagtggcctttgactactggggccagggaaccctggtcaccgtctcctca

SEQ ID NO: 31560 - protein, 118 aa, Artificial Sequence
  Description of Artificial Sequence: Synthetic polypeptide
QITLKESGPTLVKPTQTLTLTCTFSGFSLSTGGVGVGWIRQPPGKALEWLALIYWDDDKRYSPSLKSRLTITKDTPKNQVVLTMTNMDPVDTATYYCAHLIAVAFDYWGQGTLVTVSS

SEQ ID NO: 31561 - DNA, 387 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaaataataaatcctatgcagactccgtgaagggccgattcaccatctccagagacatttccaagaacacgctgtttctgcaaatgaacagcctgagagccgatgacacggctgtgtattactgtgcgagagatcgagattattgtagtggtaccagctgcccttattattactactacggtatggacgtctggggccaagggaccacggtcaccgtctcctca

SEQ ID NO: 31562 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGNNKSYADSVKGRFTISRDISKNTLFLQMNSLRADDTAVYYCARDRDYCSGTSCPYYYYYGMDVWGQGTTVTVSS

SEQ ID NO: 31563 - DNA, 354 bp, Artificial Sequence
  Description of Artificial Sequence: Synthetic polynucleotide
cagatcaccttgaaggagtctggtccttcgctggtgaaacccacacagaccctcacgctgacctgcaccttctctgggttctcactcagcactagtggagtgggtgtgggctggatccgtcagcccccaggaaaggccctggagtggcttgtattcatttattgggatgatgataagcgctacagcccatctctgaagagcaggctcaccatcaccaaggacacctccaaaaaccaggtggtccttacaatgaccaacatggaccctgtggacacagccacatattactgtgcacaccttatagcagtggcctttgactactggggccagggaaccctggtcaccgtctcctca

SEQ ID NO: 31564 - protein, 118 aa, Artificial Sequence
  Description of Artificial Sequence: Synthetic polypeptide
QITLKESGPSLVKPTQTLTLTCTFSGFSLSTSGVGVGWIRQPPGKALEWLVFIYWDDDKRYSPSLKSRLTITKDTSKNQVVLTMTNMDPVDTATYYCAHLIAVAFDYWGQGTLVTVSS

SEQ ID NO: 31565 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagaagtggtggttactactggagctggatccgccagcacccagggaagggcctggagtggattggatacatctattacagtgggagcacctactacaacccgtccctcaggagtcgagcttccatatcagtagacacgtctaagaaccagttctccctgaagctgagctctgtgactgccgcggacacggccgtgtattactgtgcgagagattcaccagtggctggtactgactactggggccagggaaccctggtcaccgtctcctca

SEQ ID NO: 31566 - protein, 119 aa, Artificial Sequence
  Description of Artificial Sequence: Synthetic polypeptide
QVQLQESGPGLVKPSQTLSLTCTVSGGSIRSGGYYWSWIRQHPGKGLEWIGYIYYSGSTYYNPSLRSRASISVDTSKNQFSLKLSSVTAADTAVYYCARDSPVAGTDYWGQGTLVTVSS

SEQ ID NO: 31567 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaaataataaatcctatgcagactccgtgaagggccgattcaccatctccagagacatttccaaaaacacgctgtatctgcaaatgaacagcctgagagccgaggacacggctgtgtattactgtgcgagggatcgagattattgtagtagtaccagctgcccttattattactactacggtatggacgtctggggccaagggaccacggtcaccgtctcctca

SEQ ID NO: 31568 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGNNKSYADSVKGRFTISRDISKNTLYLQMNSLRAEDTAVYYCARDRDYCSSTSCPYYYYYGMDVWGQGTTVTVSS

SEQ ID NO: 31569 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtcgggattcaccttcagtcgatatggcatgcactgggtccgccaggctccaggcaaggggctggagtgggtggcagttttttggtatgatggaagtaataaagactatgcagactccgtgaagggccgattcaccatctccagagacaattccaagaacacgctgtatctgcaaatgaacagcctgagagccgaggacacggctgtgtattactgtgcgagagatcgagattattgtagtagtaccagctgcccttactactactactacggtatggacgtctggggccaagggaccacggtcaccgtctcctca

SEQ ID NO: 31570 - protein, 129 aa, Artificial Sequence
  Description of Artificial Sequence: Synthetic polypeptide
QVQLVESGGGVVQPGRSLRLSCAASGFTFSRYGMHWVRQAPGKGLEWVAVFWYDGSNKDYADSVKGRFTISRDNSKNTLYLQMNSLRAEDTAVYYCARDRDYCSSTSCPYYYYYGMDVWGQGTTVTVSS

SEQ ID NO: 31571 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacattgggagtgtttactacaacccgtccctcaagagtcgagttaccatatcagtagacacgtctaagaaccagttctccctgaagctgagctctgtgactgccgcggacacggccgtgtactactgtgcgagagatgcccccgacttcggtatggacgtctggggccaagggaccacggtcaccgtctcctca

SEQ ID NO: 31572 - protein, 119 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYIGSVYYNPSLKSRVTISVDTSKNQFSLKLSSVTAADTAVYYCARDAPDFGMDVWGQGTTVTVSS

SEQ ID NO: 31573 - DNA, 387 bp, Artificial Sequence; identical to SEQ ID NO: 31567
  Description of Artificial Sequence: Synthetic polynucleotide

SEQ ID NO: 31574 - protein, 129 aa, Artificial Sequence; identical to SEQ ID NO: 31568
  Description of Artificial Sequence: Synthetic polypeptide

SEQ ID NO: 31575 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaaataataaatcctatgcagactccgtgaagggccgattcaccatctacagagacatttccaagaacacgctgtatctgcaaatgaacagcctgagagccgaggacacggctgtgtattactgtgcgagagatcgagattattgtagtagtaccagctgcccttattattactactacggtatggacgtctggggccaagggaccacggtcaccgtctcctca

SEQ ID NO: 31576 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGNNKSYADSVKGRFTIYRDISKNTLYLQMNSLRAEDTAVYYCARDRDYCSSTSCPYYYYYGMDVWGQGTTVTVSS

SEQ ID NO: 31577 - DNA, 354 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactggtggagtgggtgtgggctggatccgtcagcccccaggaaaggccctggagtggcttgcactcatttattgggatgatgataagcgctacagcccatctctgaagagcaggctcaccatcaccaaggacacccccaaaaaccaggtggtccttacaatgaccaacatggaccctgtggacacagccacatattactgtgcacaccttatagcagtggcctgtgactactggggccagggaaccctggtcaccgtctcctca

SEQ ID NO: 31578 - protein, 118 aa, Artificial Sequence
  Description of Artificial Sequence: Synthetic polypeptide
QITLKESGPTLVKPTQTLTLTCTFSGFSLSTGGVGVGWIRQPPGKALEWLALIYWDDDKRYSPSLKSRLTITKDTPKNQVVLTMTNMDPVDTATYYCAHLIAVACDYWGQGTLVTVSS

SEQ ID NO: 31579 - DNA, 387 bp, Artificial Sequence; identical to SEQ ID NO: 31567
  Description of Artificial Sequence: Synthetic polynucleotide

SEQ ID NO: 31580 - protein, 129 aa, Artificial Sequence; identical to SEQ ID NO: 31568
  Description of Artificial Sequence: Synthetic polypeptide

SEQ ID NO: 31581 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttattagtggtggtggtactaccacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31582 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSVISGGGTTTYYADSVKGRFTISRDNSKNTLYLQMNSLRAEDTAVYYCAKWRGNPTDYGMDVWGQGTTVTVSS

SEQ ID NO: 31583 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttgtatggtatggtggaaatgataaagactttgcagactccgtgacgggccgattcaccatctccagagacatttccaagaacacactgtatctgcaaatgaacagcctgagagccgaggacacggctgtgtattactgtgcgagagatcgggattattgtagtggtggtagctgcccttactactactactacggtatggacgtctggggccaagggaccacggtcaccgtctcctca

SEQ ID NO: 31584 - protein, 129 aa, Artificial Sequence
  Description of Artificial Sequence: Synthetic polypeptide
QVQLVESGGGVVQPGRSLRLSCAASGFTFSTYGMHWVRQAPGKGLEWVAVVWYGGNDKDFADSVTGRFTISRDISKNTLYLQMNSLRAEDTAVYYCARDRDYCSGGSCPYYYYYGMDVWGQGTTVTVSS

SEQ ID NO: 31585 - DNA, 390 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcatcagttatgatatcaattgggtgcgacaggccactggacaagggcttgagtggatgggatggatgaaccctaacagtggtaacacaggctatgcacagaagttccagggcagagtcaccatgaccaggaacacctccaaaagcacagcctacatggagctgagcagcctgagatctgaggacacggccgtgtattactgtgcgagaggagattattactatgatagtagtggtcaccagccttactactactactacggtatggacgtctggggccaagggaccacggtcaccgtctcctca

SEQ ID NO: 31586 - protein, 130 aa, Artificial Sequence
  Description of Artificial Sequence: Synthetic polypeptide
QVQLVQSGAEVKKPGASVKVSCKASGYTFISYDINWVRQATGQGLEWMGWMNPNSGNTGYAQKFQGRVTMTRNTSKSTAYMELSSLRSEDTAVYYCARGDYYYDSSGHQPYYYYYGMDVWGQGTTVTVSS

SEQ ID NO: 31587 - DNA, 357 bp, Artificial Sequence
  Description of Artificial Sequence: Synthetic polynucleotide
cagatcaccttgaaggagtctggtcctacgctggtgaaacccacacagcccctcacgctgacctgtaccttctctgggttctcactcagcactactggagtgggtgtgggctggatccgtcagcccccaggaaaggccctggagtggcttggaatccttttttggaatgatgatgagcgctacagcccatctctgaagagcaggctcaccatcaccaaggacacctccaaaaaccaggtggtccttacaatgaccaacatggaccctgtggacacagccacatattactgtgcacacaaatcgcagctcgtctactttgactactggggccagggaaccctggtcaccgtctcctca

SEQ ID NO: 31588 - protein, 119 aa, Artificial Sequence
  Description of Artificial Sequence: Synthetic polypeptide
QITLKESGPTLVKPTQPLTLTCTFSGFSLSTTGVGVGWIRQPPGKALEWLGILFWNDDERYSPSLKSRLTITKDTSKNQVVLTMTNMDPVDTATYYCAHKSQLVYFDYWGQGTLVTVSS

SEQ ID NO: 31589 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaaggacgtattgtagtggtaccacctgcccctactactactactacggtctgggcgtctggggccaagggaccacggtcaccgtctcctca

SEQ ID NO: 31590 - protein, 129 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARERTYCSGTTCPYYYYYGLGVWGQGTTVTVSS

SEQ ID NO: 31591 - DNA, 351 bp, Artificial Sequence
  Description of Artificial Sequence: Synthetic polynucleotide
caggtacagctggtggagtctgggggaggcgtggtccagcctgggaggtccctgagactctcctgtgcagcgtctggattcaccttcagtagttatggcatgctctgggtccgccaggctccaggcaaggggctggagtgggtgacagttatatggtatgatggaagtggtaaatactatgcagactccgtgaagggccgattcaccatctccagagacaattccaagaacacactgtatctgcaaatgaacagcctgagagccgaggacacggctgtttattactgtgcgagagagaatttttggagtggtgactactggggccagggaaccctggtcaccgtctcctca

SEQ ID NO: 31592 - protein, 117 aa, Artificial Sequence
  Description of Artificial Sequence: Synthetic polypeptide
QVQLVESGGGVVQPGRSLRLSCAASGFTFSSYGMLWVRQAPGKGLEWVTVIWYDGSGKYYADSVKGRFTISRDNSKNTLYLQMNSLRAEDTAVYYCARENFWSGDYWGQGTLVTVSS

SEQ ID NO: 31593 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagtgtctggattcacctttagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgagaggggggcccccgttctctacggtgactatgtactttgactactggggccagggaaccctggtcaccgtctcctca

SEQ ID NO: 31594 - protein, 123 aa, Artificial Sequence
  Description of Artificial Sequence: Synthetic polypeptide
QVQLVESGGGVVQPGRSLRLSCAVSGFTFSSYGMHWVRQAPGKGLEWVAIIWYDGSNKYYADSVKGRFTISRDNSKNTLYLQMNSLRAEDTAVYYCARGGPPFSTVTMYFDYWGQGTLVTVSS

SEQ ID NO: 31595 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcaattatatggtatgatggaagtgataaatactatgcagactccgtgaagggccgattcaccatctccagagacaattccaagaacacgctgtatctgcaaatgaacaccctgagagccgaagacacggctgtgtatttctgtgcgagaggggggcccccgttctctacggtgactatgtactttgactactggggccagggaaccctggtcaccgtctcctca

SEQ ID NO: 31596 - protein, 123 aa, Artificial Sequence
  Description of Artificial Sequence: Synthetic polypeptide
QVQLVESGGGVVQPGRSLRLSCAASGFTFSNYGMHWVRQAPGKGLEWVAIIWYDGSDKYYADSVKGRFTISRDNSKNTLYLQMNTLRAEDTAVYFCARGGPPFSTVTMYFDYWGQGTLVTVSS

SEQ ID NO: 31597 - DNA, 354 bp, Artificial Sequence
  Description of Artificial Sequence: Synthetic polynucleotide
cagatcaccctgaaggagtctggtcctacgctggtgaaacccacacagaccctcacgttgacctgcaccttctctgggttctcactcaccactggtggagtgggtgtgggctggatccgtcagcccccaggaaaggccctggagtggcttgcactcatttattggaatgatgatgagcgctacagcccatctctgaagagcaggctcaccatcaccaaggacacctccaaaaaccaggtggtccttacaatgaccaacatggaccctgtggacacagccacatattactgtgcacacattatagcagtggccttccagcattggggccagggcaccctggtcaccgtctcctca

SEQ ID NO: 31598 - protein, 118 aa, Artificial Sequence
  Description of Artificial Sequence: Synthetic polypeptide
QITLKESGPTLVKPTQTLTLTCTFSGFSLTTGGVGVGWIRQPPGKALEWLALIYWNDDERYSPSLKSRLTITKDTSKNQVVLTMTNMDPVDTATYYCAHIIAVAFQHWGQGTLVTVSS

SEQ ID NO: 31599 - DNA, 357 bp, Artificial Sequence
  Description of Artificial Sequence: Synthetic polynucleotide
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttggattcatttcttggaatgatgataagcgctacagcccatctctgaagagcagcctcaccatcaccaaggacacctccaaaaaccaggtggtccttacaatgaccaacatggaccctgtggacacagccacatattactgtgcacacaaagcagcagctgttgcttttgatatctggggccaagggacaatggtcaccgtctcttca

SEQ ID NO: 31600 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLGFISWNDDKRYSPSLKSSLTITKDTSKNQVVLTMTNMDPVDTATYYCAHKAAAVAFDIWGQGTMVTVSS

SEQ ID NO: 31601 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattggatacatctattacagtgggagcacctactacaacccgtccctcaagagtcgagtcaccatatcagtagacacgtctaagaaccagttctccctgaagctgagctctgtgactgccgcggacacggccgtttattactgtgcgagagattccccactacgaggctttgactactggggccagggaaccctggtcaccgtctcctca

SEQ ID NO: 31602 - protein, 119 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDSPLRGFDYWGQGTLVTVSS

SEQ ID NO: 31603 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagaagctatggcatgcattgggtccgccaggctccaggcaaggggctggagtgggtggcagttataatatatgatggaagttataagtactatgcagactccgtgaagggccgattcaccatctccagagacaattccaagaacacgctgtatctgcaaatgaacagcctgagagctgaggacacggctgtgtattactgtgcgagaacgtatagcgggggtatggacgtctggggccaagggaccacggtcaccgtctcctca

SEQ ID NO: 31604 - protein, 117 aa, Artificial Sequence
  Description of Artificial Sequence: Synthetic polypeptide
QVQLVESGGGVVQPGRSLRLSCAASGFTFRSYGMHWVRQAPGKGLEWVAVIIYDGSYKYYADSVKGRFTISRDNSKNTLYLQMNSLRAEDTAVYYCARTYSGGMDVWGQGTTVTVSS

SEQ ID NO: 31605 - DNA, 360 bp, Artificial Sequence
  Description of Artificial Sequence: Synthetic polynucleotide
caggtacagctgcagcagtcaggtccaggactggtgaagccctcgcagaccctctcactcacctgtgacatctccggggacagtgtctctaggaaaagtgctacttggaactggatcaggcagtccccatcgagaggccttgagtggctgggaaagacatactacaggtccaagtggtataatgattatgcagtatctgtgaaaagtcgaataaccatcaatccagacacatccaagaaccagttctccctgcaattgaactctgtgactcccgaggacacggctgtgtattactgtgcaagagatccgggtggcctctttgactactggggccagggaaccctggtcaccgtctcctca

SEQ ID NO: 31606 - protein, 120 aa, Artificial Sequence
  Description of Artificial Sequence: Synthetic polypeptide
QVQLQQSGPGLVKPSQTLSLTCDISGDSVSRKSATWNWIRQSPSRGLEWLGKTYYRSKWYNDYAVSVKSRITINPDTSKNQFSLQLNSVTPEDTAVYYCARDPGGLFDYWGQGTLVTVSS

SEQ ID NO: 31607 - DNA, 375 bp, Artificial Sequence
  Description of Artificial Sequence: Synthetic polynucleotide
caggtgcagctggtggaatctgggggaggcgtggtccagcctgggaggtccctgagactctcctgtgcagcgtctggattcaccttcaataactatggcatacactgggtccgccaggctccaggcaaggggctggagtgggtggcagttatatggtttgatggagataataaatactatgcagactccgtgaagggccgattcaccatctccagagacaattccaagaacacgctgtatctgcaaatgaacagcctgagagccgaagacacggctgtgtattactgtgcgagagataactggaactacggcgatcactactactacttcggtatggacgtctggggccaagggaccacggtcaccgtctcctca

SEQ ID NO: 31608 - protein, 125 aa, Artificial Sequence
  Description of Artificial Sequence: Synthetic polypeptide
QVQLVESGGGVVQPGRSLRLSCAASGFTFNNYGIHWVRQAPGKGLEWVAVIWFDGDNKYYADSVKGRFTISRDNSKNTLYLQMNSLRAEDTAVYYCARDNWNYGDHYYYFGMDVWGQGTTVTVSS

SEQ ID NO: 31609 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaactggtactactactactacggtatggacgtctggggccaagggaccacggtcaccgtctcctca

SEQ ID NO: 31610 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCANWYYYYYGMDVWGQGTTVTVSS

SEQ ID NO: 31611 - DNA, 378 bp, Artificial Sequence
  Description of Artificial Sequence: Synthetic polynucleotide
caggtgcagctggtggagtctgggggaggcgtggtccagcctgggaggtccctgagactctcctgtgtagcgtctggattcaccttcagtagctatggcatgcactgggtccgccaggctccaggcaaggggctggagtgggtggcagttatatggaatgatggaagtaaaaaataccatgtagactccgtgaagggccgatttaccatctccagagacaattccaagaacacgctgtatctgcaaatgaacagcctgagagccgaggacacggctctgtattactgtgcgagagatctggataagaggaactttccttattactactactacggtatggacgtctggggccaagggaccacggtcaccgtctcctca

SEQ ID NO: 31612 - protein, 126 aa, Artificial Sequence
  Description of Artificial Sequence: Synthetic polypeptide
QVQLVESGGGVVQPGRSLRLSCVASGFTFSSYGMHWVRQAPGKGLEWVAVIWNDGSKKYHVDSVKGRFTISRDNSKNTLYLQMNSLRAEDTALYYCARDLDKRNFPYYYYYGMDVWGQGTTVTVSS

SEQ ID NO: 31613 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtttgatggaagtaataaatactatacagactccgtgaagggccgattcaccatctccagagacaattccaagaacacgctgtatctgcaaatgaacagcctgagagccgaggacacggctgtatattattgtgcgagagataactggaactacggcgattactactactactacggtatggacgtctggggccaagggaccacggtcaccgtctcctca

SEQ ID NO: 31614 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWFDGSNKYYTDSVKGRFTISRDNSKNTLYLQMNSLRAEDTAVYYCARDNWNYGDYYYYYGMDVWGQGTTVTVSS

SEQ ID NO: 31615 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggaactgagcaggctgagatctgacgacacggccgtgtattactgtgcgagagatagagcagtggctggaaactacttctactacggtatggacgtctggggccaagggaccacggtcaccgtctcctca

SEQ ID NO: 31616 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDRAVAGNYFYYGMDVWGQGTTVTVSS

SEQ ID NO: 31617 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaacttcagaagctatggcatgcattgggtccgccaggctccaggcaaggggctggagtgggtggcagttataatatatgatggaagttataagtactatgcagactccgtgaagggccgattcaccatctccagagacaattccaagaacacgctgtatctgcaaatgaacagcctgagagctgaggacacggctgtgtattactgtgcgagaacgtatagcgggggtatggacgtctggggccaagggaccacggtcaccgtctcctca

SEQ ID NO: 31618 - protein, 117 aa, Artificial Sequence
  Description of Artificial Sequence: Synthetic polypeptide
QVQLVESGGGVVQPGRSLRLSCAASGFNFRSYGMHWVRQAPGKGLEWVAVIIYDGSYKYYADSVKGRFTISRDNSKNTLYLQMNSLRAEDTAVYYCARTYSGGMDVWGQGTTVTVSS

SEQ ID NO: 31619 - DNA, 357 bp, Artificial Sequence
  Description of Artificial Sequence: Synthetic polynucleotide
caggtgcagctggtggagtctgggggagacgtggtccagcctggaaggtccctgagactctcctgtgaagcgtctggattcaccttcagtagctatggcctgcactgggtccgccaggctcccggcaagggactggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaactggtactactactactacggtatggacgtctggggccaagggaccacggtcaccgtctcctca

SEQ ID NO: 31620 - protein, 119 aa, Artificial Sequence
  Description of Artificial Sequence: Synthetic polypeptide
QVQLVESGGDVVQPGRSLRLSCEASGFTFSSYGLHWVRQAPGKGLEWVAVIWYDGSNKYYADSVKGRFTISRDNSKNTLYLQMNSLRAEDTAVYYCANWYYYYYGMDVWGQGTTVTVSS

SEQ ID NO: 31621 - DNA, 360 bp, Artificial Sequence
  Description of Artificial Sequence: Synthetic polynucleotide
caggtacagttgcagcagtcaggtccaggactggtgaagccctcgcagaccctctcactcacctgtgccatctccggggacagtgtctctaggaaaagtgctacttggaactggatcaggcagtccccatcgagaggccttgagtggctgggaaggacatactacaggtccaagtggtataatgattatgcagtatctgtgaaaagtcgaataatcatcaatccagacacatccaagaaccagttctccctgcagctgaactctgtgactcccgaggacacggctgtgtattactgtgcaagagatccgggtggcctctttgactactggggccagggaaccctggtcaccgtctcctca

SEQ ID NO: 31622 - protein, 120 aa, Artificial Sequence
  Description of Artificial Sequence: Synthetic polypeptide
QVQLQQSGPGLVKPSQTLSLTCAISGDSVSRKSATWNWIRQSPSRGLEWLGRTYYRSKWYNDYAVSVKSRIIINPDTSKNQFSLQLNSVTPEDTAVYYCARDPGGLFDYWGQGTLVTVSS

SEQ ID NO: 31623 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtaactatggcatgcactgggtccgccaggctccaggcaaggggctggagtgggtggcagttatatggtttggtggagataataaatactatgcagactccgtgaggggccgattcaccatctccagagacaattccaagaacacgctgtatctgcaaatgaacagcctgagagccgaggacacggctgtgttttactgtgcgagagataactggaactacggcgatcactactactattacggaatggacgtctggggccaagggaccacggtcaccgtctcctca

SEQ ID NO: 31624 - protein, 125 aa, Artificial Sequence
  Description of Artificial Sequence: Synthetic polypeptide
QVQLVESGGGVVQPGRSLRLSCAASGFTLSNYGMHWVRQAPGKGLEWVAVIWFGGDNKYYADSVRGRFTISRDNSKNTLYLQMNSLRAEDTAVFYCARDNWNYGDHYYYYGMDVWGQGTTVTVSS

SEQ ID NO: 31625 - DNA, 351 bp, Artificial Sequence; identical to SEQ ID NO: 31603
  Description of Artificial Sequence: Synthetic polynucleotide

SEQ ID NO: 31626 - protein, 117 aa, Artificial Sequence; identical to SEQ ID NO: 31604
  Description of Artificial Sequence: Synthetic polypeptide

SEQ ID NO: 31627 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagaagtggtggtgactactggagctggatccgccagcacccaggggagggcctggagtggattgggtacatctattacagtgggatcacctactacaatccgtccctcaagagtcgagttaccatatcagtagacacgtctaagaaccagttctccctgaagctgagctctgtgactgccgcggacacggccgtgtattactgtgcgagagatagcagctcgcggggtatggacgtctggggccaagggaccacggtcaccgtctcctca

SEQ ID NO: 31628 - protein, 119 aa, Artificial Sequence
  Description of Artificial Sequence: Synthetic polypeptide
QVQLQESGPGLVKPSQTLSLTCTVSGGSIRSGGDYWSWIRQHPGEGLEWIGYIYYSGITYYNPSLKSRVTISVDTSKNQFSLKLSSVTAADTAVYYCARDSSSRGMDVWGQGTTVTVSS

SEQ ID NO: 31629 - DNA, 354 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagaagttactactggatctggatccggcagcccccagggaagggactggagtggattgggtatatctattacagtgggagtactaagtacaacccctccctcaagagtcgagtcaccatatcagtagacacgtccaagaaccagttctccctgaaactgagctctgtgaccgctgcggacacggccgtgtattactgtgcgagaaagggagtgggaaccatccactttgactactggggccagggaaccctggtcaccgtctcctca

SEQ ID NO: 31630 - protein, 118 aa, Artificial Sequence
  Description of Artificial Sequence: Synthetic polypeptide
QVQLQESGPGLVKPSETLSLTCTVSGGSIRSYYWIWIRQPPGKGLEWIGYIYYSGSTKYNPSLKSRVTISVDTSKNQFSLKLSSVTAADTAVYYCARKGVGTIHFDYWGQGTLVTVSS

SEQ ID NO: 31631 - DNA, 357 bp, Artificial Sequence; identical to SEQ ID NO: 31627
  Description of Artificial Sequence: Synthetic polynucleotide

SEQ ID NO: 31632 - protein, 119 aa, Artificial Sequence; identical to SEQ ID NO: 31628
  Description of Artificial Sequence: Synthetic polypeptide

SEQ ID NO: 31633 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatatggtttgatggaagtaataaatactatgcagactccgtgaagggccgattcaccatctccagagacaattccaagaacacgctgtatctgcaaatgaacagcctgagagccgaggacacggctgtgtattactgtgcgagagataactggaactacggcgatcactactactactacggtatggacgtctggggccaagggaccacggtcaccgtctcctca

SEQ ID NO: 31634 - protein, 125 aa, Artificial Sequence
  Description of Artificial Sequence: Synthetic polypeptide
QVQLVESGGGVVQPGRSLRLSCAASGFTLSSYGMHWVRQAPGKGLEWVAVIWFDGSNKYYADSVKGRFTISRDNSKNTLYLQMNSLRAEDTAVYYCARDNWNYGDHYYYYGMDVWGQGTTVTVSS

SEQ ID NO: 31635 - DNA, 375 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtaattatggcatgcactgggtccgccaggctccaggcaaggggctggagtgggtggcagttatatggtttggtggagataataaatactatgcagactccgtgaagggccgattcaccatctccagagacaattccaagaacacgctgtatctgcaaatgaacagcctgagagccgaggacacggctgtgttttactgtgcgagagataactggaactacggcgatcactactactattacggtatggacgtctggggccaagggaccacggtcaccgtctcctca

SEQ ID NO: 31636 - protein, 125 aa, Artificial Sequence
  Description of Artificial Sequence: Synthetic polypeptide
QVQLVESGGGVVQPGRSLRLSCAASGFTLSNYGMHWVRQAPGKGLEWVAVIWFGGDNKYYADSVKGRFTISRDNSKNTLYLQMNSLRAEDTAVFYCARDNWNYGDHYYYYGMDVWGQGTTVTVSS

SEQ ID NO: 31637 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtttccatggcatgcactgggtccgccaggctccaggcaaggggctggagtgggtggcagttatatggtatgatggaagtaaaaaatactatgcagactccgtgaagggccgattcaccatctccagagacaattccaagaacacgctgcatctgcaaatgaacagtctgagagccgaggacacggctgtgtattactgtgcgaaagaagggtatagcagtggcttttacagggggtttgacaactggggccagggaaccctggtcaccgtctcctca

SEQ ID NO: 31638 - protein, 122 aa, Artificial Sequence
  Description of Artificial Sequence: Synthetic polypeptide
QVQLVESGGGVVQPGRSLRLSCAASGFTFSFHGMHWVRQAPGKGLEWVAVIWYDGSKKYYADSVKGRFTISRDNSKNTLHLQMNSLRAEDTAVYYCAKEGYSSGFYRGFDNWGQGTLVTVSS

SEQ ID NO: 31639 - DNA, 381 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtgacacttatatggtttgatggaagtaataaatactatgcagactccgtgaagggccgattcaccatctccagagacaattccaagaacacgctgtatctgcaaatgaacagcctgagagccgaggacacggctgtgtattactgtgcgagagatcgggtgggaggtactagtcctccttactactactactacggtatggacgtctggggccaagggaccacggtcaccgtctcctca

SEQ ID NO: 31640 - protein, 127 aa, Artificial Sequence
  Description of Artificial Sequence: Synthetic polypeptide
QVQLVESGGGVVQPGRSLRLSCAASGFTFSTYGMHWVRQAPGKGLEWVTLIWFDGSNKYYADSVKGRFTISRDNSKNTLYLQMNSLRAEDTAVYYCARDRVGGTSPPYYYYYGMDVWGQGTTVTVSS

SEQ ID NO: 31641 - DNA, 366 bp, Artificial Sequence
  Description of Artificial Sequence: Synthetic polynucleotide
caggtgcagctggtgcagtctggggctgaggtgaagaagcctggggcctcagtgaaggtctcctgtaaggtttctggatataccttcaccggctacaatatgcactgggtgcgacaggcccctggacaagggcttgagtggatgggatggatcaaccctaatagtggtggcacaaactatgcacacaagtttcagggcagggtcaccatgaccagggacacgtccatcagcacagcctacatggagctgagcaggctgagatctgacgacacggccgtgtattactgtgcgagagatttctatgatagtggtggagaagggtggttcgacccctggggccagggaaccctggtcaccgtctcctca

SEQ ID NO: 31642 - protein, 122 aa, Artificial Sequence
  Description of Artificial Sequence: Synthetic polypeptide
QVQLVQSGAEVKKPGASVKVSCKVSGYTFTGYNMHWVRQAPGQGLEWMGWINPNSGGTNYAHKFQGRVTMTRDTSISTAYMELSRLRSDDTAVYYCARDFYDSGGEGWFDPWGQGTLVTVSS

SEQ ID NO: 31643 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtgacagttatatggaatgatggaagtaataaatactatgcagactccgtgaagggccgatttaccatctccagagacaattccaagaacacgctgtatctgcaaatgaacagcctgagagccgaggacacggctctgtattactgtgcgagagatctggataagaggaactttccttattactactactacggtatggacgtctggggccaagggaccacggtcaccgtctcctca

SEQ ID NO: 31644 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVTVIWNDGSNKYYADSVKGRFTISRDNSKNTLYLQMNSLRAEDTALYYCARDLDKRNFPYYYYYGMDVWGQGTTVTVSS

SEQ ID NO: 31645 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcccccagggaagggcctggagtggattgggtacatctattacactgggagcacctactacaacccgtccctcaagagtcgagttaccatatcagtagacacgtctaagaaccagttctccctgaagctgagctctgtgactgccgcggacacggccgtgtattactgtgcgagagacgatcccctctacggaatggacgtctggggccaagggaccacggtcaccgtctcctca

SEQ ID NO: 31646 - protein, 119 aa, Artificial Sequence
  Description of Artificial Sequence: Synthetic polypeptide
QVQLQESGPGLVKPSQTLSLTCTVSGGSISSGGYYWSWIRQPPGKGLEWIGYIYYTGSTYYNPSLKSRVTISVDTSKNQFSLKLSSVTAADTAVYYCARDDPLYGMDVWGQGTTVTVSS

SEQ ID NO: 31647 - DNA, 342 bp, Artificial Sequence
  Description of Artificial Sequence: Synthetic polynucleotide
caggtgcagctgcaggagtcgggcccaggactggtgaagccgtcggagaccctgtccctcacctgcactgtctctggtggctccatcagtaattactactggagctggatccggcagcccgccgggaagggactggagtggattgggcggatctattccagtgggagcaccaactacaacccctccctcaagagtcgagtcaccatgtcagtagacacgtccaagaaccagttctccctgaagctgaactctgtgaccgccgcggacacggccgtgtattactgtgcgaaagggtgggagctaaactactggggccagggaaccctggtcaccgtctcctca

SEQ ID NO: 31648 - protein, 114 aa, Artificial Sequence
  Description of Artificial Sequence: Synthetic polypeptide
QVQLQESGPGLVKPSETLSLTCTVSGGSISNYYWSWIRQPAGKGLEWIGRIYSSGSTNYNPSLKSRVTMSVDTSKNQFSLKLNSVTAADTAVYYCAKGWELNYWGQGTLVTVSS

SEQ ID NO: 31649 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagagggagtacctactacaatccgtccctcaagagtcgagttaccatatcagtggacacgtctaagaaccagttctccctgaaactgaactctgtgactgccgcggacacggccgtgtattactgtgcgagagactccccggtgacaggatttgactattggggccagggaatcctggtcaccgtctcctca

SEQ ID NO: 31650 - protein, 119 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYRGSTYYNPSLKSRVTISVDTSKNQFSLKLNSVTAADTAVYYCARDSPVTGFDYWGQGILVTVSS

SEQ ID NO: 31651 - DNA, 357 bp, Artificial Sequence
  Description of Artificial Sequence: Synthetic polynucleotide
caggtgcagctgcaggagtcgggcccaggagtggtgaagccttcacagaccctgtccctcacctgcactgtctctggtggctccatcagcagtggtggtgactactggagctggatccgccagcacccagggaagggcctggagtggattgggtacatctattacagtgggcccacctactacaacccgtccctcaagagtcgacttaccatgtcagcagacacgtctaagaaccagttctccctgaagctgagctctgtgactgccgcggacacggccgtgtattactgtgcgagagatagctccctctacggtatggacgtctggggccaagggacaacggtcaccgtctcctca

SEQ ID NO: 31652 - protein, 119 aa, Artificial Sequence
  Description of Artificial Sequence: Synthetic polypeptide
QVQLQESGPGVVKPSQTLSLTCTVSGGSISSGGDYWSWIRQHPGKGLEWIGYIYYSGPTYYNPSLKSRLTMSADTSKNQFSLKLSSVTAADTAVYYCARDSSLYGMDVWGQGTTVTVSS

SEQ ID NO: 31653 - DNA, 342 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgggaggatgggagctaaactactggggccagggaaccctggtcaccgtctcctca

SEQ ID NO: 31654 - protein, 114 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGGWELNYWGQGTLVTVSS

SEQ ID NO: 31655 - DNA, 357 bp, Artificial Sequence
  Description of Artificial Sequence: Synthetic polynucleotide
gaggtgcagctggtggagtctgggggaggcttggtaatgcctggggggtcccttagcctctcctgtgcagcctctggattcactttcagtaacgcctacatgacctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatcccggtggtatctttgactactggggccagggaaccctggtcaccgtctcctca

SEQ ID NO: 31656 - protein, 119 aa, Artificial Sequence
  Description of Artificial Sequence: Synthetic polypeptide
EVQLVESGGGLVMPGGSLSLSCAASGFTFSNAYMTWVRQAPGKGLEWVGRIKSKTDGGTTDYAAPVKGRFTISRDDSKNTLYLQMNSLKTEDTAVYYCTTDPGGIFDYWGQGTLVTVSS

SEQ ID NO: 31657 - DNA, 372 bp, Artificial Sequence; identical to SEQ ID NO: 28197
  Description of Artificial Sequence: Synthetic polynucleotide

SEQ ID NO: 31658 - protein, 124 aa, Artificial Sequence; identical to SEQ ID NO: 28198
  Description of Artificial Sequence: Synthetic polypeptide

SEQ ID NO: 31659 - DNA, 357 bp, Artificial Sequence
  Description of Artificial Sequence: Synthetic polynucleotide
caggtgcagctgcaggagtcgggcccaggactggtgaagccttcacagaccctgtccctcatctgcactgtctctggtggctccatcagaagtggtggtgactactggagctggatccgccagcacccagggaagggcctggagtggattgggtacatctattacagtgggagcacctactacaacccgtctctcaagagtcgagttaccatatcagtagacacgtctaagaaccagttctccctgaagctgagctctgtgactgccgcggacacggccgtttattactgtgcgagagatcactccctctacggtatggacgtctggggccaagggaccacggtcaccgtctcctca

SEQ ID NO: 31660 - protein, 119 aa, Artificial Sequence
  Description of Artificial Sequence: Synthetic polypeptide
QVQLQESGPGLVKPSQTLSLICTVSGGSIRSGGDYWSWIRQHPGKGLEWIGYIYYSGSTYYNPSLKSRVTISVDTSKNQFSLKLSSVTAADTAVYYCARDHSLYGMDVWGQGTTVTVSS

SEQ ID NO: 31661 - DNA, 378 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggaatgatggaagtaaaaaataccatgtagactccgtgaagggccgatttaccatctccagagacaattccaagaacacgctgtatctgcaaatgaacagcctgagagccgaggacacggctctgtattactgtgcgagagatctggataagaggaactttccttattactactactacggtatggacgtctggggccaagggaccacggtcaccgtctcctca

SEQ ID NO: 31662 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAVIWNDGSKKYHVDSVKGRFTISRDNSKNTLYLQMNSLRAEDTALYYCARDLDKRNFPYYYYYGMDVWGQGTTVTVSS

SEQ ID NO: 31663 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggtgactactggagctggatccgccagcacccagggaagggcctggagtggattgggtacatctattacagtgggagtacctactacaacccgtccctcaagagtcgagttaccatatcagtagacacgtctaagaaccagttctccctgaagctgagctctgtgactgccgcggacacggccgtgtattactgtgcgagagatggggctcggcacggtatggacgtctggggccaagggaccacggtcaccgtctcctca

SEQ ID NO: 31664 - protein, 119 aa, Artificial Sequence
  Description of Artificial Sequence: Synthetic polypeptide
QVQLQESGPGLVKPSQTLSLTCTVSGGSISSGGDYWSWIRQHPGKGLEWIGYIYYSGSTYYNPSLKSRVTISVDTSKNQFSLKLSSVTAADTAVYYCARDGARHGMDVWGQGTTVTVSS

SEQ ID NO: 31665 - DNA, 378 bp, Artificial Sequence; identical to SEQ ID NO: 31643
  Description of Artificial Sequence: Synthetic polynucleotide

SEQ ID NO: 31666 - protein, 126 aa, Artificial Sequence; identical to SEQ ID NO: 31644
  Description of Artificial Sequence: Synthetic polypeptide

SEQ ID NO: 31667 - DNA, 357 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatatattactagtagtggtaataccatatactacgcagactctgtgaagggccgattcaccatctccagggacaacgccaagaactcactgtatctgcaaatgaacagcctgagagccgaggacacggccgtatattactgtgcgagagatagtcgatattttgactggtttgactactggggccagggaaccctggtcaccgtctcttca

SEQ ID NO: 31668 - protein, 119 aa, Artificial Sequence
  Description of Artificial Sequence: Synthetic polypeptide
QVQLVESGGGLVKPGGSLRLSCAASGFTFSDYYMSWIRQAPGKGLEWVSYITSSGNTIYYADSVKGRFTISRDNAKNSLYLQMNSLRAEDTAVYYCARDSRYFDWFDYWGQGTLVTVSS

SEQ ID NO: 31669 - DNA, 342 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcaggaattactactggagctggatccggcagcccgccgggaagggactggagtggattgggcgtatctatagcagtgggagcaccaactacaacccctccctcaagagtcgagtctccatgtcagtagacacgtccaagaaccagttctccctgaagctgagttctgtgaccgccgcggacacggccgtgtattactgtacgagagggtgggagctaaacaactggggccagggaaccctggtcaccgtctcctca

SEQ ID NO: 31670 - protein, 114 aa, Artificial Sequence
  Description of Artificial Sequence: Synthetic polypeptide
QVQLQESGPGLVKPSETLSLTCTVSGGSIRNYYWSWIRQPAGKGLEWIGRIYSSGSTNYNPSLKSRVSMSVDTSKNQFSLKLSSVTAADTAVYYCTRGWELNNWGQGTLVTVSS

SEQ ID NO: 31671 - DNA, 372 bp, Artificial Sequence
  Description of Artificial Sequence: Synthetic polynucleotide
caggtgcaggtggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtgccacaaactatgcacagaagtttcagggcagggtcaccatgaccagggacacgtccatcagcacagcctacatggagctgaacaggctgagatctgacgacacggccgtgtattactgtgcgagagcctattactatggttcggggacttattataacgagttcgactactggggccagggaaccctggtcaccgtctcctca

SEQ ID NO: 31672 - protein, 124 aa, Artificial Sequence
  Description of Artificial Sequence: Synthetic polypeptide
QVQVVQSGAEVKKPGASVKVSCKASGYTFTGYYMHWVRQAPGQGLEWMGWINPNSGATNYAQKFQGRVTMTRDTSISTAYMELNRLRSDDTAVYYCARAYYYGSGTYYNEFDYWGQGTLVTVSS

SEQ ID NO: 31673 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaacccttacagtggtggcacaaactatgcacagaagtttcaggacagggtcaccatgaccagggacacgtccatcaccacagcctacatggaactgagcaggctgagatctgacgacacggccgtgtattactgtgcgagagatagagcagtggctggaaactacttctactacggtatggacgtctggggccaggggaccacggtcaccgtctcctca

SEQ ID NO: 31674 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPYSGGTNYAQKFQDRVTMTRDTSITTAYMELSRLRSDDTAVYYCARDRAVAGNYFYYGMDVWGQGTTVTVSS

SEQ ID NO: 31675 - DNA, 366 bp, Artificial Sequence
  Description of Artificial Sequence: Synthetic polynucleotide
caggtgcagctggtgcagtctggggctgaggtgaagaagcctggggcctcagtgaaggtctcctgtaaggtttctggatataccttcaccggctacaatatgcactgggtgcgacaggcccctggacaagggcttgagtggatgggatggatcaaccctaatagtggtggcacaaactatgcacacaagtttcagggcagggtcaccatgaccagggacacgtccatcagcacagcctacatggaactgagcaggctgagatccgacgacacggccgtgtattactgtgcgagagattactatgatactagtggagaagggtggttcgacccctggggccagggaaccctggtcaccgtctcctca

SEQ ID NO: 31676 - protein, 122 aa, Artificial Sequence
  Description of Artificial Sequence: Synthetic polypeptide
QVQLVQSGAEVKKPGASVKVSCKVSGYTFTGYNMHWVRQAPGQGLEWMGWINPNSGGTNYAHKFQGRVTMTRDTSISTAYMELSRLRSDDTAVYYCARDYYDTSGEGWFDPWGQGTLVTVSS

SEQ ID NO: 31677 - DNA, 372 bp, Artificial Sequence
  Description of Artificial Sequence: Synthetic polynucleotide
caggtgcagctgctgcagtctggggctgaggtgaggaagcctggggcctcagtgagggtctcctgcaaggcttctggatacaccttcaccggctactatatacactgggtgcgacaggcccctggacaagggcttgagtggatgggatggatcaaccctaacagtggtggcacaaactatgcacagaggtttcagggcagggtcaccatgaccagggacacgtccatcagcacagcctacatggagctgagcaggctgagatctgacgacacggccgtgtattactgtgcgagagagatagcagtggctgggaactacttctactacggtatgggcgtctggggccaagggaccacggtcgccgtctcctca

SEQ ID NO: 31678 - protein, 124 aa, Artificial Sequence
  Description of Artificial Sequence: Synthetic polypeptide
QVQLLQSGAEVRKPGASVRVSCKASGYTFTGYYIHWVRQAPGQGLEWMGWINPNSGGTNYAQRFQGRVTMTRDTSISTAYMELSRLRSDDTAVYYCAREIAVAGNYFYYGMGVWGQGTTVAVSS

SEQ ID NO: 31679 - DNA, 372 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagaatttactactggagctggatccggcagcccccagggaagggactggagtggattgggtatgtctattacagtgggagcaccacctacaacccctccctcaagagtcgagtcaccatatcagtagacacgtccaagaaccagttctccctgaagctgaactctgtgaccgctgcggacacggccgtgtattactgtgtgagagaaagggggagtagccacagatggggggactactacggaatggacgtctggggccgagggaccacggtcaccgtctcctca

SEQ ID NO: 31680 - protein, 124 aa, Artificial Sequence
  Description of Artificial Sequence: Synthetic polypeptide
QVQLQESGPGLVKPSETLSLTCTVSGGSIRIYYWSWIRQPPGKGLEWIGYVYYSGSTTYNPSLKSRVTISVDTSKNQFSLKLNSVTAADTAVYYCVRERGSSHRWGDYYGMDVWGRGTTVTVSS

SEQ ID NO: 31681 - DNA, 357 bp, Artificial Sequence; identical to SEQ ID NO: 31645
  Description of Artificial Sequence: Synthetic polynucleotide

SEQ ID NO: 31682 - protein, 119 aa, Artificial Sequence; identical to SEQ ID NO: 31646
  Description of Artificial Sequence: Synthetic polypeptide

SEQ ID NO: 31683 - DNA, 366 bp, Artificial Sequence
  Description of Artificial Sequence: Synthetic polynucleotide
caggtgcagctggtgcagtctggggctgaggtgaagaagcctggggcctcagtgaaggtctcctgtaaggtttctggatataccttcaccggctacaatatgcactgggtgcgacaggcccctggacaagggcttgagtggatgggatggatcaaccctaatagtggtggcacaaactatgcacacaagtttcagggcagggtcaccatgaccagggacacgtccatcagcacagcctacatggagctgagcaggctgagatctgacgacacggccgtgtattactgtgcgagagattactatgatagtagtggagaagggtggttcgacccctggggccagggaaccctggtcaccgtctcctca

SEQ ID NO: 31684 - protein, 122 aa, Artificial Sequence
  Description of Artificial Sequence: Synthetic polypeptide
QVQLVQSGAEVKKPGASVKVSCKVSGYTFTGYNMHWVRQAPGQGLEWMGWINPNSGGTNYAHKFQGRVTMTRDTSISTAYMELSRLRSDDTAVYYCARDYYDSSGEGWFDPWGQGTLVTVSS

SEQ ID NO: 31685 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcacctttagtttccatggcatgcactgggtccgccaggctccaggcaaggggctggagtgggtggcagttatatggtatgatggaagtaaaaaatactatgcagactccgtgaagggccgattcaccatctccagagacaattccaagaacacgctgcatctgcaaatgaacagtctgagagccgaggacacggctgtgtattactgtgcgaaagaagggtttagcagtggcttttacagggggtttgacaactggggccagggaaccctggtcaccgtctcctca

SEQ ID NO: 31686 - protein, 122 aa, Artificial Sequence
  Description of Artificial Sequence: Synthetic polypeptide
QVQLVESGGGVVQPGRSLRLSCAASGFTFSFHGMHWVRQAPGKGLEWVAVIWYDGSKKYYADSVKGRFTISRDNSKNTLHLQMNSLRAEDTAVYYCAKEGFSSGFYRGFDNWGQGTLVTVSS

SEQ ID NO: 31687 - DNA, 357 bp, Artificial Sequence; identical to SEQ ID NO: 31627
  Description of Artificial Sequence: Synthetic polynucleotide

SEQ ID NO: 31688 - protein, 119 aa, Artificial Sequence; identical to SEQ ID NO: 31628
  Description of Artificial Sequence: Synthetic polypeptide

SEQ ID NO: 31689 - DNA, 366 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtttctatggcatgcactgggtccgccaggctccaggcaaggggctggagtgggtggcagttatttggtatgatggaagtagtaaatactatgcagactccgtgaagggccgattcaccgtctccagagacaattccaagaacacgctgtatctgcaaatgaacagcctgagagccgaggacacggctgtgtattattgtgcgaaagaagggtatagcagtggcttttacaggggatttgccaactggggccagggaaccctggtcaccgtctcctca

SEQ ID NO: 31690 - protein, 122 aa, Artificial Sequence
  Description of Artificial Sequence: Synthetic polypeptide
QVQLVESGGGVVQPGRSLRLSCAASGFTFSFYGMHWVRQAPGKGLEWVAVIWYDGSSKYYADSVKGRFTVSRDNSKNTLYLQMNSLRAEDTAVYYCAKEGYSSGFYRGFANWGQGTLVTVSS

SEQ ID NO: 31691 - DNA, 372 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagaatttactactggagctggatccggcagaccccagggaagggactggagtggattggatatatctattacagtgggagcaccacctacaacccctccctcaagagtcgagtcaccatatcagtagacacgtccaagaaccagttctccctgaagctgaactctgtgaccgctgcggacacggccgtgtattactgtgtgagagaaagggggagtagccacagatggggggactactacggaatggacgtctggggccgagggaccacggtcaccgtctcctca

SEQ ID NO: 31692 - protein, 124 aa, Artificial Sequence
  Description of Artificial Sequence: Synthetic polypeptide
QVQLQESGPGLVKPSETLSLTCTVSGGSIRIYYWSWIRQTPGKGLEWIGYIYYSGSTTYNPSLKSRVTISVDTSKNQFSLKLNSVTAADTAVYYCVRERGSSHRWGDYYGMDVWGRGTTVTVSS

SEQ ID NO: 31693 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggtgactattggagctggatccgccagcacccagggaagggcctggagtggattgggtacatctattatagtgggagcacctactacaacccgtccctcaagagtcgagttaccatatcagtagacacgtctaagaaccagttctccctgaagctgaactctgtgactgccgcggacacggccgtgtattactgtgcgagagatggagcagctctgggtatggacgtctggggccaagggaccacggtcaccgtctcctca

SEQ ID NO: 31694 - protein, 119 aa, Artificial Sequence
  Description of Artificial Sequence: Synthetic polypeptide
QVQLQESGPGLVKPSQTLSLTCTVSGGSISSGGDYWSWIRQHPGKGLEWIGYIYYSGSTYYNPSLKSRVTISVDTSKNQFSLKLNSVTAADTAVYYCARDGAALGMDVWGQGTTVTVSS

SEQ ID NO: 31695 - DNA, 354 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagaagttactactggagctggatccggcagcccccagggaagggactggagtggattgggtatatctattacagtgggagtactaagtacaacccctccctcaagagtcgagtcaccatatcagtagacacgtccaagaaccagttctccctgaaactgagctctgtgaccgctgcggacacggccgtgtactactgtgcgagaaagggagtgggaaccatccactttgactactggggccagggaaccctggtcaccgtctcctca

SEQ ID NO: 31696 - protein, 118 aa, Artificial Sequence
  Description of Artificial Sequence: Synthetic polypeptide
QVQLQESGPGLVKPSETLSLTCTVSGGSIRSYYWSWIRQPPGKGLEWIGYIYYSGSTKYNPSLKSRVTISVDTSKNQFSLKLSSVTAADTAVYYCARKGVGTIHFDYWGQGTLVTVSS

SEQ ID NO: 31697 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggtgactactggagctggatccgccagcacccagggaagggcctggagtggattgggtacatctattacagtgggagcacctactacaacccgtccctcaagagtcgagttaccatatcagtagacacgtctaagaaccagttctccctgaagctgaactctgtgactgccgcggacacggccgtgtattactgtgcgagagatggagcagctctgggtatggacgtctggggccaagggaccacggtcaccgtctcctca

SEQ ID NO: 31698 - protein, 119 aa, Artificial Sequence; identical to SEQ ID NO: 31694
  Description of Artificial Sequence: Synthetic polypeptide

SEQ ID NO: 31699 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggtgactactggagctggatccgccagcacccagggaagggcctggagtggattgggtacatctattacagagggagcacctactacaacccgtccctcaagagtcgagttaccatatcagtagacacgtctaagaaccagttctccctgaagctgagctctgtgactgccgcggacacggccgtgtattactgtgcgagagatgcagcagcccacggcatggacgtctggggccaagggaccacggtcaccgtctcctca

SEQ ID NO: 31700 - protein, 119 aa, Artificial Sequence
  Description of Artificial Sequence: Synthetic polypeptide
QVQLQESGPGLVKPSQTLSLTCTVSGGSISSGGDYWSWIRQHPGKGLEWIGYIYYRGSTYYNPSLKSRVTISVDTSKNQFSLKLSSVTAADTAVYYCARDAAAHGMDVWGQGTTVTVSS

SEQ ID NO: 31701 - DNA, 360 bp, Artificial Sequence
  Description of Artificial Sequence: Synthetic polynucleotide
caggtacagctgcagcagtcaggtccaggactggtgaagccctcgcagaccctctcactcacctgtgccatctccggggacagtgtctctcgcatcaatcctacttggaactggatcaggcagtccccatcgagaggccttgagtggctgggaaggacatactacaggtccaagtggtatcatgtttatgcagtatctgtgaaaagtcgaataaccatcaacccagacacatccaagaaccagttctccctgcagctgaattctgtgactcccgaggacacggcagtgtattactgtgcaagagatcctggggggctctttgactactggggccagggaaccctggtcaccgtctcctca

SEQ ID NO: 31702 - protein, 120 aa, Artificial Sequence
  Description of Artificial Sequence: Synthetic polypeptide
QVQLQQSGPGLVKPSQTLSLTCAISGDSVSRINPTWNWIRQSPSRGLEWLGRTYYRSKWYHVYAVSVKSRITINPDTSKNQFSLQLNSVTPEDTAVYYCARDPGGLFDYWGQGTLVTVSS

SEQ ID NO: 31703 - DNA, 354 bp, Artificial Sequence
  Description of Artificial Sequence: Synthetic polynucleotide
caggtgcagctggtggagtctgggggaggcgtggtccagccggggaggtccctgagactctcctgtgcagcgtctggattcaccttcagtaactatggcatgcactgggtccgccaggctccaggcaaggggctggagtgggtggcaattatatggtttgatggaagtaatgaatactatgcagactccgtgaagggccgattcaccatctccagagacaattccatgagcacgctgtatctgcaaatgaacagcctgagagccgaggacacggctgtgtattactgtgcgagagaaagtgggagctatgctctttatatctggggccaagggacaatggtcaccgtctcttca

SEQ ID NO: 31704 - protein, 118 aa, Artificial Sequence
  Description of Artificial Sequence: Synthetic polypeptide
QVQLVESGGGVVQPGRSLRLSCAASGFTFSNYGMHWVRQAPGKGLEWVAIIWFDGSNEYYADSVKGRFTISRDNSMSTLYLQMNSLRAEDTAVYYCARESGSYALYIWGQGTMVTVSS

SEQ ID NO: 31705 - DNA, 360 bp, Artificial Sequence
  Description of Artificial Sequence: Synthetic polynucleotide
caggttcagctgcagcagtcaggtccaggactggtgaagccctcgcagaccctctcactcacctgtgccatctccggggacagtgtctctcgcaccaatcctacttggaactggatcaggcagtccccatcgagaggccttgagtggctgggaaggacatactacaggtccaagtggtatcatgtttatgcactatctgtgaaaagtcgaataaccatcaccccagacacatccaagaaccagttctccctgcagctgaactctgtgactcccgaggacacggctgtgtattactgtgcaagagatcctgggggcctctttgactactggggccagggaaccctggtcaccgtctcctca

SEQ ID NO: 31706 - protein, 120 aa, Artificial Sequence
  Description of Artificial Sequence: Synthetic polypeptide
QVQLQQSGPGLVKPSQTLSLTCAISGDSVSRTNPTWNWIRQSPSRGLEWLGRTYYRSKWYHVYALSVKSRITITPDTSKNQFSLQLNSVTPEDTAVYYCARDPGGLFDYWGQGTLVTVSS

SEQ ID NO: 31707 - DNA, 354 bp, Artificial Sequence; identical to SEQ ID NO: 31703
  Description of Artificial Sequence: Synthetic polynucleotide

SEQ ID NO: 31708 - protein, 118 aa, Artificial Sequence; identical to SEQ ID NO: 31704
  Description of Artificial Sequence: Synthetic polypeptide

SEQ ID NO: 31709 - DNA, 354 bp, Artificial Sequence
  Description of Artificial Sequence: Synthetic polynucleotide
caggtgcagctggtggagtccgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtataactgtgcgagagagggtgggagctaccaccttgactactggggccagggaatcctggtcaccgtctcctca

SEQ ID NO: 31710 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYNCAREGGSYHLDYWGQGILVTVSS

SEQ ID NO: 31711 - DNA, 354 bp, Artificial Sequence
  Description of Artificial Sequence: Synthetic polynucleotide
gaggtgcagctggtggagtctgggggaggcttggtacagcctggggggtccctgagactctcctgtgcagcctctggattcacttttagaagttatagcatgaactgggtccgccaggctccagggaaggggctggagtgggttttatacattagtagtagtagtagtatcaaaaagtacgcagactctgtgaagggccgattcaccatctccagagacaatgccaagaactcactgtatctgcaaatgaacagcctgagagacgaggacacggctgtgtattactgtgtgagagatgatgggagctactactttgactactggggccagggaaccctggtcaccgtctcctca

SEQ ID NO: 31712 - protein, 118 aa, Artificial Sequence
  Description of Artificial Sequence: Synthetic polypeptide
EVQLVESGGGLVQPGGSLRLSCAASGFTFRSYSMNWVRQAPGKGLEWVLYISSSSSIKKYADSVKGRFTISRDNAKNSLYLQMNSLRDEDTAVYYCVRDDGSYYFDYWGQGTLVTVSS

SEQ ID NO: 31713 - DNA, 354 bp, Artificial Sequence; identical to SEQ ID NO: 31709
  Description of Artificial Sequence: Synthetic polynucleotide

SEQ ID NO: 31714 - protein, 118 aa, Artificial Sequence; identical to SEQ ID NO: 31710
  Description of Artificial Sequence: Synthetic polypeptide

SEQ ID NO: 31715 - DNA, 357 bp, Artificial Sequence
  Description of Artificial Sequence: Synthetic polynucleotide
caggtgcagctgcaggagtcgggcccaggactggtgaagccgtcacagaccctgtccctcacctgcactgtctctggtggctccatcagcagtggtggttcctactggagctggatccgccagcacccagggaagggcctggagtggattgggtacatctattacattgggaccacctactacaacccgtccctcaagagtcgagttaccatatcagtagacacgtctacgaaccacttctccctgaaactgagctctgtgactgccgcggacacggccgtgtattactgtgcgagagatgagccattgaccggtatggacgtctggggccaagggaccacggtcaccgtctcctca

SEQ ID NO: 31716 - protein, 119 aa, Artificial Sequence
  Description of Artificial Sequence: Synthetic polypeptide
QVQLQESGPGLVKPSQTLSLTCTVSGGSISSGGSYWSWIRQHPGKGLEWIGYIYYIGTTYYNPSLKSRVTISVDTSTNHFSLKLSSVTAADTAVYYCARDEPLTGMDVWGQGTTVTVSS

SEQ ID NO: 31717 - DNA, 348 bp, Artificial Sequence
  Description of Artificial Sequence: Synthetic polynucleotide
caggtgcagctggtgcagtctggggctgaggtgaagaagcctggggcctcagtgaagatctcctgcaaggcttctggattcaccttcaccgactactatatgaactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagtaggctgagatctgacgacacggccgtgtattactgtgcgagagggtatgactcgttcgccccctggggccagggaaccctggtcaccgtctcctca

SEQ ID NO: 31718 - protein, 116 aa, Artificial Sequence
  Description of Artificial Sequence: Synthetic polypeptide
QVQLVQSGAEVKKPGASVKISCKASGFTFTDYYMNWVRQAPGQGLEWMGWINPNSGGTNYAQKFQGRVTMTRDTSISTAYMELSRLRSDDTAVYYCARGYDSFAPWGQGTLVTVSS

SEQ ID NO: 31719 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggggggactggaaccccgagggtttggacgtctggggccaagggaccacggtcaccgtctcctca

SEQ ID NO: 31720 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGLDVWGQGTTVTVSS

SEQ ID NO: 31721 - DNA, 357 bp, Artificial Sequence
  Description of Artificial Sequence: Synthetic polynucleotide
caggtgcacctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggggggactggaaccccgagggtatggacgtctggggccaagggaccacggtcatcgtctcctca

SEQ ID NO: 31722 - protein, 119 aa, Artificial Sequence
  Description of Artificial Sequence: Synthetic polypeptide
QVHLVESGGGVVQPGRSLRLSCAASGFTFSNYGMHWVRQAPGKGLEWVAVIWYDGSNKYYADSVKGRFTISRDNSKNTLYLQMNSLRAEDTAVYYCARGDWNPEGMDVWGQGTTVIVSS

SEQ ID NO: 31723 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacaccctgagagccgaggacacggctatctattactgtgcgaggggggactggaaccccgagggtttggacgtctggggccaagggaccacggtcaccgtctcctca

SEQ ID NO: 31724 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYYADSVKGRFTISRDNSKNTLYLQMNTLRAEDTAIYYCARGDWNPEGLDVWGQGTTVTVSS

SEQ ID NO: 31725 - DNA, 354 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcagttatatggtatgatggaagtaataaatactatgcagactccgtgaagggccgattcaccatcgccagagacaattccaagaacacgctgtatctgcaaatgaacagcctgagagccgaggacacggctgtgtattactgtgcgagagatcctgggagctacgggttcgacccctggggccagggaaccctggtcaccgtctcctca

SEQ ID NO: 31726 - protein, 118 aa, Artificial Sequence
  Description of Artificial Sequence: Synthetic polypeptide
QVQLVESGGGVVQPGRSLRLSCAASGFTFSSYAMHWVRQAPGKGLEWVAVIWYDGSNKYYADSVKGRFTIARDNSKNTLYLQMNSLRAEDTAVYYCARDPGSYGFDPWGQGTLVTVSS

SEQ ID NO: 31727 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcaggaactatggcatgcactgggtccgccaggctccaggcaaggggctggagtgggtgtcaattatatggtttgatggaagtgatcaatactatgcagactccgtgaagggccgattcaccatctccagagacaactccaagaacacgctgtacctgcaaatgaacagcctgagagccgaggacacggctgtttattactgtgcgagaggcctctctgtctactactacggtatgggcgtctggggccaagggaccacggtcaccgtctcctca

SEQ ID NO: 31728 - protein, 120 aa, Artificial Sequence
  Description of Artificial Sequence: Synthetic polypeptide
QVQLVESGGGVVQPGRSLRLSCAASGFTFRNYGMHWVRQAPGKGLEWVSIIWFDGSDQYYADSVKGRFTISRDNSKNTLYLQMNSLRAEDTAVYYCARGLSVYYYGMGVWGQGTTVTVSS

SEQ ID NO: 31729 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctacaaatgaacagcctgagagccgaggacacggctgtgtattactgtgcgaggggggactggaaccccgagggtttggacgtctggggccaagggaccacggtcaccgtctcctca

SEQ ID NO: 31730 - protein, 119 aa, Artificial Sequence; identical to SEQ ID NO: 31720
  Description of Artificial Sequence: Synthetic polypeptide

SEQ ID NO: 31731 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggacccgccagcacccagggaagggcctggagtggattgggtacatctattacgttgggagcacctactacaacccgtccctcaagagtcgagttaccatatcagtagacacgtctaagaaccagttctccctgaagctgagttctgtgactgccgcggacacggccgtgtattactgtgcgagagatgggccattgagcggtatggacgtctggggccaagggaccacggtcaccgtctcctca

SEQ ID NO: 31732 - protein, 119 aa, Artificial Sequence
  Description of Artificial Sequence: Synthetic polypeptide
QVQLQESGPGLVKPSQTLSLTCTVSGGSISSGGYYWSWTRQHPGKGLEWIGYIYYVGSTYYNPSLKSRVTISVDTSKNQFSLKLSSVTAADTAVYYCARDGPLSGMDVWGQGTTVTVSS

SEQ ID NO: 31733 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagaagtggtggtgactactggagctggatccgccagcacccagggaagggcctggagtggattggatacatctattatagtgggagcacctactacaacccgtccctcaagagtcgagttaccatattactagacacgtctaagaaccagttctccctgaagctgagctctgtgactgtcgcggacacggccgtgtattactgtgcgagagattcagcagtgtacaatatggacgtctggggccaagggaccacggtcaccgtctcctca

SEQ ID NO: 31734 - protein, 119 aa, Artificial Sequence
  Description of Artificial Sequence: Synthetic polypeptide
QVQLQESGPGLVKPSQTLSLTCTVSGGSIRSGGDYWSWIRQHPGKGLEWIGYIYYSGSTYYNPSLKSRVTILLDTSKNQFSLKLSSVTVADTAVYYCARDSAVYNMDVWGQGTTVTVSS

SEQ ID NO: 31735 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggtgactactggagctggatccgccagcacccagggaagggcctggagtggattgggtacatctattacactgggagcaactactacaacccgtccctcaagagtcgagttaccatatcagtagacacgtctaagaatcagttctccctgaacctgatctctgtgactgccgcggacacggccgtgtattactgtgcgagagattcagcagtgtacggtatggacgtctggggccaagggaccacggtcaccgtctcctca

SEQ ID NO: 31736 - protein, 119 aa, Artificial Sequence
  Description of Artificial Sequence: Synthetic polypeptide
QVQLQESGPGLVKPSQTLSLTCTVSGGSISSGGDYWSWIRQHPGKGLEWIGYIYYTGSNYYNPSLKSRVTISVDTSKNQFSLNLISVTAADTAVYYCARDSAVYGMDVWGQGTTVTVSS

SEQ ID NO: 31737 - DNA, 357 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggggggactggaaccccgagggtatggacgtctggggccaagggacctcggtcaccgtctcctca

SEQ ID NO: 31738 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGMDVWGQGTSVTVSS

SEQ ID NO: 31739 - DNA, 357 bp, Artificial Sequence
  Description of Artificial Sequence: Synthetic polynucleotide
caggtgcacctggtggagtctgggggaggcgtggtccaggctgggaggtccctgagactctcctgtgcagcgtctggattcaccttcagtaactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggggggactggaaccccgagggtatggacgtctggggccaagggaccacggtcatcgtctcctca

SEQ ID NO: 31740 - protein, 119 aa, Artificial Sequence
  Description of Artificial Sequence: Synthetic polypeptide
QVHLVESGGGVVQAGRSLRLSCAASGFTFSNYGMHWVRQAPGKGLEWVAVIWYDGSNKYYADSVKGRFTISRDNSKNTLYLQMNSLRAEDTAVYYCARGDWNPEGMDVWGQGTTVIVSS

SEQ ID NO: 31741 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcggactccgtgaagggccgattcaccatctccagagacaattccaagaacacgctgtatctgcaaatgaacagcctgagagccgaggacacggctgtgtattactgtgcgaggggggactggaaccccgagggtttggacgtctggggccaagggaccacggtcaccgtctcctca

SEQ ID NO: 31742 - protein, 119 aa, Artificial Sequence; identical to SEQ ID NO: 31720
  Description of Artificial Sequence: Synthetic polypeptide

SEQ ID NO: 31743 - DNA, 357 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactgtgcagactccgtgaagggccgattcaccatctccagagacaattccacgaacacgctgtatctgcaaatgaacagcctgagagccgaggacacggctgtgtattactgtgcgaggggagactggaaccccgagggtttggacgtctggggccaagggaccacggtcaccgtctcctca

SEQ ID NO: 31744 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYCADSVKGRFTISRDNSTNTLYLQMNSLRAEDTAVYYCARGDWNPEGLDVWGQGTTVTVSS

SEQ ID NO: 31745 - DNA, 357 bp, Artificial Sequence
  Description of Artificial Sequence: Synthetic polynucleotide
caggtgcagctgcaggagtcgggcccaggactggtgaagccttcacagaccctgtccctcacctgcagtgtctctggtggctccatcagaagtggtggtgactactggagctggatccgccagcacccagggaagggcctggagtggattgggtatatgtattacagtgggagcacctactacaacccgtccctcaagagtcgagttaccatatcagtagacacgtctaagaaccagttctccctgaagctgagttctgtgactgtcgcggacacggccgtgtattactgtgcgcgagattcagcagtgtacggtatggacgtctggggccaagggaccacggtcaccgtctcctca

SEQ ID NO: 31746 - protein, 119 aa, Artificial Sequence
  Description of Artificial Sequence: Synthetic polypeptide
QVQLQESGPGLVKPSQTLSLTCSVSGGSIRSGGDYWSWIRQHPGKGLEWIGYMYYSGSTYYNPSLKSRVTISVDTSKNQFSLKLSSVTVADTAVYYCARDSAVYGMDVWGQGTTVTVSS

SEQ ID NO: 31747 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagaagtggtggtgactactggagttggatccgccagcacccagggaagggcctggagtggattgggtacatctattacagtgggagcacctactacaacccgtccctcaagagtcgagttaccatatcaggagacacgtctaagaaccagttctccctgaagctgagctctgtgactgccgcggacacggccgtgtattactgtgcgagggatagcagctcctacggtatggacgtctggggccaagggaccacggtcaccgtctcctca

SEQ ID NO: 31748 - protein, 119 aa, Artificial Sequence
  Description of Artificial Sequence: Synthetic polypeptide
QVQLQESGPGLVKPSQTLSLTCTVSGGSIRSGGDYWSWIRQHPGKGLEWIGYIYYSGSTYYNPSLKSRVTISGDTSKNQFSLKLSSVTAADTAVYYCARDSSSYGMDVWGQGTTVTVSS

SEQ ID NO: 31749 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgcatctgcaaatgaacagcctgagagccgaggacacggctgtgtattactgtgcgaggggggactggaaccccgagggtatggacgtctggggccaagggacctcggtcaccgtctcctca

SEQ ID NO: 31750 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYYADSVKGRFTISRDNSKNTLHLQMNSLRAEDTAVYYCARGDWNPEGMDVWGQGTSVTVSS

SEQ ID NO: 31751 - DNA, 357 bp, Artificial Sequence
  Description of Artificial Sequence: Synthetic polynucleotide
caggtgcagctggtggaatctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgtttctgcaaatgaacagcctgagagtcgaggacacggctgtgtattattgtgcgaggggggactggaaccccgagggtatggacgtctggggccaagggaccacggtcaccgtctcctca

SEQ ID NO: 31752 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYYADSVKGRFTISRDNSKNTLFLQMNSLRVEDTAVYYCARGDWNPEGMDVWGQGTTVTVSS

SEQ ID NO: 31753 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagaagtggtggtgactactggagctggatccgccagcacccagggaagggcctggagtggattgggtacatctattatagtgggagcacctactacaacccgtccctcaagagtcgagttaccatatcactagacacgtctaagaaccagttctccctgaagctgagctctgtgactgtcgcggacacggccgtgtattactgtgcgagagattcagcagtgtacaatatggacgtctggggccaagggaccacggtcaccgtctcctca

SEQ ID NO: 31754 - protein, 119 aa, Artificial Sequence
  Description of Artificial Sequence: Synthetic polypeptide
QVQLQESGPGLVKPSQTLSLTCTVSGGSIRSGGDYWSWIRQHPGKGLEWIGYIYYSGSTYYNPSLKSRVTISLDTSKNQFSLKLSSVTVADTAVYYCARDSAVYNMDVWGQGTTVTVSS

SEQ ID NO: 31755 - DNA, 348 bp, Artificial Sequence
  Description of Artificial Sequence: Synthetic polynucleotide
caggtgcagctggtgcagtctggggctgaggtgaagaagcctggggcctccgtgaagatctcctgcagggcttctggattcaccttcaccgactactatatgaactgggtgcgacaggcccctggacaagggcttgagtggatgggatggatcaaccctaagaatggtggcacaaactatgcacagaagtttcagggcagggtcaccatgaccagggacacgtccctcagcagagcctacatggagctgagtaggctgagatctgacgacacggccgtgtattactgtgcgaaagggtatgattcgttcgccccctggggccagggaaccctggtcaccgtctcctca

SEQ ID NO: 31756 - protein, 116 aa, Artificial Sequence
  Description of Artificial Sequence: Synthetic polypeptide
QVQLVQSGAEVKKPGASVKISCRASGFTFTDYYMNWVRQAPGQGLEWMGWINPKNGGTNYAQKFQGRVTMTRDTSLSRAYMELSRLRSDDTAVYYCAKGYDSFAPWGQGTLVTVSS

SEQ ID NO: 31757 - DNA, 357 bp, Artificial Sequence; identical to SEQ ID NO: 31747
  Description of Artificial Sequence: Synthetic polynucleotide

SEQ ID NO: 31758 - protein, 119 aa, Artificial Sequence; identical to SEQ ID NO: 31748
  Description of Artificial Sequence: Synthetic polypeptide

SEQ ID NO: 31759 - DNA, 363 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagtactgctttttactactggagctggatccgccagcacccagggaagggcctggagtggattgggtacatctatttcagtgggagcacctactacaacccgtccctcaagagtcgagttaccatatcagtagacacgtctaagaaccagttctccctgaacctgagctctgtgactgccgcggacacggccgtgtattactgtgcgagagcaaggggatatcactacagtatctttgactactggggccagggaaccctggtcaccgtctcctca

SEQ ID NO: 31760 - protein, 121 aa, Artificial Sequence
  Description of Artificial Sequence: Synthetic polypeptide
QVQLQESGPGLVKPSQTLSLTCTVSGGSISTAFYYWSWIRQHPGKGLEWIGYIYFSGSTYYNPSLKSRVTISVDTSKNQFSLNLSSVTAADTAVYYCARARGYHYSIFDYWGQGTLVTVSS

SEQ ID NO: 31761 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggtgattactggagctggatccgccagcacccagggaagggcctggagtggattgggtacatctattacagtgggcccacctactacaacccgtccctcaagagtcgagttaccatatcagtagacacgtctaagaaccagttctccctgaagctgagctctgtgactgccgcggacacggccgtgtattattgtgcgagagatggggctgcggagggtatggacgtctggggccaagggaccacggtcaccgtctcctca

SEQ ID NO: 31762 - protein, 119 aa, Artificial Sequence
  Description of Artificial Sequence: Synthetic polypeptide
QVQLQESGPGLVKPSQTLSLTCTVSGGSISSGGDYWSWIRQHPGKGLEWIGYIYYSGPTYYNPSLKSRVTISVDTSKNQFSLKLSSVTAADTAVYYCARDGAAEGMDVWGQGTTVTVSS

SEQ ID NO: 31763 - DNA, 357 bp, Artificial Sequence
  Description of Artificial Sequence: Synthetic polynucleotide
caggtgcagttgcaggagtcgggcccaggactggtgaagccttcacagaccctgtccctcacctgcactgtctctggtggctccatcagcagtggtggtgactactggagctggatccgccagcacccagggaagggcctggagtggattgggtacatctattacactgggagcaactactacaacccgtccctcaagagtcgagttaccatatcagtagacacgtctaagaatcagttctccctgaaggtgatctctgtgactgccgcggacacggccgtgtattactgtgcgagagattcagcagtgtacggtatggacgtctggggccaagggaccacggtcaccgtctcctca

SEQ ID NO: 31764 - protein, 119 aa, Artificial Sequence
  Description of Artificial Sequence: Synthetic polypeptide
QVQLQESGPGLVKPSQTLSLTCTVSGGSISSGGDYWSWIRQHPGKGLEWIGYIYYTGSNYYNPSLKSRVTISVDTSKNQFSLKVISVTAADTAVYYCARDSAVYGMDVWGQGTTVTVSS

SEQ ID NO: 31765 - DNA, 357 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtaacgcctggatgcactgggtccgccaggctccagggaaggggctggagtgggttggccgtattaaaagcaaaactaatggtgggacaacagactacgctgcacccgtgaaaggcagattcaccatttcaagagatgattcaaaaaacacgctgtatctgcaaatgaacagcctgaaaaccgaggacacagccgtgtattactgtaccacagatccgggggggatctttgactactggggccagggaaccctggtcaccgtctcctca

SEQ ID NO: 31766 - protein, 119 aa, Artificial Sequence
  Description of Artificial Sequence: Synthetic polypeptide
EVQLVESGGGLVKPGGSLRLSCAASGFTFSNAWMHWVRQAPGKGLEWVGRIKSKTNGGTTDYAAPVKGRFTISRDDSKNTLYLQMNSLKTEDTAVYYCTTDPGGIFDYWGQGTLVTVSS

SEQ ID NO: 31767 - DNA, 357 bp, Artificial Sequence
  Description of Artificial Sequence: Synthetic polynucleotide
cagacgcagctggtggagtctgggggaggcgtggtccagcctgggaggtccctgagactctcctgtgcagcgtctggattcaccttcagtcactatggcatgcactgggtccgccaggctccaggcaaggggctggaatgggtggcagttatatggtatgatggaagtaatgagtactatgcagactccgtgaagggccgattcaccatctccagagacaattccaagaacacgctgtatctgcaaatgaacagcctgagagccgaggacacggctgtgtattactgtgcgaggggggactggaaccccgagggtatggacgtctggggccaagggaccacggtcaccgtctcctca

SEQ ID NO: 31768 - protein, 119 aa, Artificial Sequence
  Description of Artificial Sequence: Synthetic polypeptide
QTQLVESGGGVVQPGRSLRLSCAASGFTFSHYGMHWVRQAPGKGLEWVAVIWYDGSNEYYADSVKGRFTISRDNSKNTLYLQMNSLRAEDTAVYYCARGDWNPEGMDVWGQGTTVTVSS

SEQ ID NO: 31769 - DNA, 357 bp, Artificial Sequence; identical to SEQ ID NO: 31745
  Description of Artificial Sequence: Synthetic polynucleotide

SEQ ID NO: 31770 - protein, 119 aa, Artificial Sequence; identical to SEQ ID NO: 31746
  Description of Artificial Sequence: Synthetic polypeptide

SEQ ID NO: 31771 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggggggactggaaccccgagggtttggacgtctggggccaagggaccacggtcaccgtctcctca

SEQ ID NO: 31772 - protein, 119 aa, Artificial Sequence; identical to SEQ ID NO: 31720
  Description of Artificial Sequence: Synthetic polypeptide

SEQ ID NO: 31773 - DNA, 357 bp, Artificial Sequence; identical to SEQ ID NO: 31745
  Description of Artificial Sequence: Synthetic polynucleotide

SEQ ID NO: 31774 - protein, 119 aa, Artificial Sequence; identical to SEQ ID NO: 31746
  Description of Artificial Sequence: Synthetic polypeptide

SEQ ID NO: 31775 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggtgattactggagctggatccgccagcacccagggaagggcctggagtggattgggtacatctattacagtgggcccacctactacaacccgtccctcaagagtcgagttaccatatcagtagacacgtctaagaaccagttctccctgaagctgagctctgtgactgccgcggacacggccgtgtattattgtgcgagagatggggctgcggagggtttggacgtctggggccaagggaccacggtcaccgtctcctca

SEQ ID NO: 31776 - protein, 119 aa, Artificial Sequence
  Description of Artificial Sequence: Synthetic polypeptide
QVQLQESGPGLVKPSQTLSLTCTVSGGSISSGGDYWSWIRQHPGKGLEWIGYIYYSGPTYYNPSLKSRVTISVDTSKNQFSLKLSSVTAADTAVYYCARDGAAEGLDVWGQGTTVTVSS

SEQ ID NO: 31777 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatgccatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctgggactgggatacttctttgactactggggccagggaaccctagtcaccgtctcctca

SEQ ID NO: 31778 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVIWYDGSNKYYADSVKGRFTISRDNSKNTLYLQMNSLRAEDTAVYYCARDLGLGYFFDYWGQGTLVTVSS

SEQ ID NO: 31779 - DNA, 357 bp, Artificial Sequence
  Description of Artificial Sequence: Synthetic polynucleotide
caggtgcacctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattattgtgcgaggggggactggaaccccgagggtatggacgtctggggccaagggaccacggtcatcgtctcctca

SEQ ID NO: 31780 - protein, 119 aa, Artificial Sequence; identical to SEQ ID NO: 31722
  Description of Artificial Sequence: Synthetic polypeptide

SEQ ID NO: 31781 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcatgcactgggtccgccaggctccaggcaaggggctggagtggatggcaattatatggtttgatggaagtgatgaatactatgcagactccgtgaagggccgattcaccatctccagagacaattccaagaacacgatgtatctgcaaatgaacagcctgagagccgaagacacggctgtgtattactgtgcgagaggcctatctgtctactactacggtatggacgtctggggccaagggaccacggtcaccgtctcctca

SEQ ID NO: 31782 - protein, 120 aa, Artificial Sequence
  Description of Artificial Sequence: Synthetic polypeptide
QVQLVESGGGVVQPGRSLRLSCAASGFTFSNYGMHWVRQAPGKGLEWMAIIWFDGSDEYYADSVKGRFTISRDNSKNTMYLQMNSLRAEDTAVYYCARGLSVYYYGMDVWGQGTTVTVSS

SEQ ID NO: 31783 - DNA, 360 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcaggaactatggcatgcactgggtccgccaggctccaggcaaggggctggagtgggtgtcaattatatggtttgatggaagtgatcagtactatgcagactccgtgaagggccgattcaccatctccagagacaattccaagaacacgctgtatctgcaaatgaacagcctgagagccgaggacacggctgtatattactgtgcgagaggcctctctgtctactactacggtatggacgtctggggccaagggaccacggtcaccgtctcctca

SEQ ID NO: 31784 - protein, 120 aa, Artificial Sequence
  Description of Artificial Sequence: Synthetic polypeptide
QVQLVESGGGVVQPGRSLRLSCAASGFTFRNYGMHWVRQAPGKGLEWVSIIWFDGSDQYYADSVKGRFTISRDNSKNTLYLQMNSLRAEDTAVYYCARGLSVYYYGMDVWGQGTTVTVSS

SEQ ID NO: 31785 - DNA, 357 bp, Artificial Sequence
  Description of Artificial Sequence: Synthetic polynucleotide
caggtgcagctggtggagtctgggggaggcgtagtccagcctgggaggtccctgagactctcctgtgcagcgtctggattcaccttcagtagctatggcttgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagtcgaggacacggctgtgtactactgtgcgaactggtactactattactacggtatggacgtctggggccaagggaccacggtcaccgtctcctca

SEQ ID NO: 31786 - protein, 119 aa, Artificial Sequence
  Description of Artificial Sequence: Synthetic polypeptide
QVQLVESGGGVVQPGRSLRLSCAASGFTFSSYGLHWVRQAPGKGLEWVAVIWYDGSNKYYADSVKGRFTISRDNSKNTLYLQMNSLRVEDTAVYYCANWYYYYYGMDVWGQGTTVTVSS

SEQ ID NO: 31787 - DNA, 360 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtaactatggcatgcactgggtccgccaggctccaggcaaggggctggagtggatggcaattatatggtttgatggaagtgatgaatactatgcagactccgtgaagggccgattcaccatctccagagacaattccaagaacacgctgtatctgcaaatgaacagcctgagagccgaggacacggctgtatattactgtgcgagaggcctatctgtctactactacggtatggacgtctggggccaagggaccacggtcaccgtctcctca

SEQ ID NO: 31788 - protein, 120 aa, Artificial Sequence
  Description of Artificial Sequence: Synthetic polypeptide
QVQLVESGGGVVQPGRSLRLSCAASGFTFSNYGMHWVRQAPGKGLEWMAIIWFDGSDEYYADSVKGRFTISRDNSKNTLYLQMNSLRAEDTAVYYCARGLSVYYYGMDVWGQGTTVTVSS

SEQ ID NO: 31789 - DNA, 357 bp, Artificial Sequence
  Description of Artificial Sequence: Synthetic polynucleotide
caggtgcagctggtggagtctgggggaggcgtggtccagcctgggaggtccctgagactctcctgtccagcgtctggattcaccttcagtcactatggcatgcactgggtccgccaggctccaggcaaggggctggagtgggtggcagtcatatggtatgatggaagtaataaatactatgcagactccgtgaagggccgattcaccatctccagagacaattccaagaatatgctgtatctgcaaatgaacagcctgagagccgaggacacggctgtgtattactgtgcgaggggggactggaaccccgagggtatggacgtctggggccaagggaccacggtcaccgtctcctca

SEQ ID NO: 31790 - protein, 119 aa, Artificial Sequence
  Description of Artificial Sequence: Synthetic polypeptide
QVQLVESGGGVVQPGRSLRLSCPASGFTFSHYGMHWVRQAPGKGLEWVAVIWYDGSNKYYADSVKGRFTISRDNSKNMLYLQMNSLRAEDTAVYYCARGDWNPEGMDVWGQGTTVTVSS

SEQ ID NO: 31791 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtcactatggcatgcactgggtccgccaggctccaggcaaggggctggagtgggtggcagttatatggtatgatggaagtaataaatactatgcagactccgtgaagggccgattcaccatctccagagacaattccaagaacacgctgcatctgcaaatgaacagcctgagagccgaggacacggctgtgtattactgtgcgaggggggactggaaccccgagggtatggacgtctggggccaagggaccacggtcaccgtctcctca

SEQ ID NO: 31792 - protein, 119 aa, Artificial Sequence
  Description of Artificial Sequence: Synthetic polypeptide
QVQLVESGGGVVQPGRSLRLSCAASGFTFSHYGMHWVRQAPGKGLEWVAVIWYDGSNKYYADSVKGRFTISRDNSKNTLHLQMNSLRAEDTAVYYCARGDWNPEGMDVWGQGTTVTVSS

SEQ ID NO: 31793 - DNA, 357 bp, Artificial Sequence; identical to SEQ ID NO: 31749
  Description of Artificial Sequence: Synthetic polynucleotide

SEQ ID NO: 31794 - protein, 119 aa, Artificial Sequence; identical to SEQ ID NO: 31750
  Description of Artificial Sequence: Synthetic polypeptide

SEQ ID NO: 31795 - DNA, 393 bp, Artificial Sequence
  Description of Artificial Sequence: Synthetic polynucleotide
caggtacagctgcagcagtcaggtccaggactggtgaagccctcgcagaccctctcactcacctgtgacatctccggggacagtgtctctagcaacagtgctgcttggaactggatcaggcagtccccatcgcgaggccttgagtggctgggaaggacatactacaggtccaagtggtataatgattatgcagtatctgtgaaaagtcgagtaaccatcaacccagacacatccaagaaccagttctccctgcagctgaactctgtgactcccgaggacacggctgtgtattactgtgcaagagaggggggcctaggatattgtagtagtaccagctgctatggaggctggttcgacccctggggccagggaaccctggtcaccgtctcctca

SEQ ID NO: 31796 - protein, 131 aa, Artificial Sequence
  Description of Artificial Sequence: Synthetic polypeptide
QVQLQQSGPGLVKPSQTLSLTCDISGDSVSSNSAAWNWIRQSPSRGLEWLGRTYYRSKWYNDYAVSVKSRVTINPDTSKNQFSLQLNSVTPEDTAVYYCAREGGLGYCSSTSCYGGWFDPWGQGTLVTVSS

SEQ ID NO: 31797 - DNA, 366 bp, Artificial Sequence
  Description of Artificial Sequence: Synthetic polynucleotide
caggtacacctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaaaaatggtggcacaaactatgcacagaagtttcagggcagggtcaccatgaccagggacgcgtccatcagcacaacctacatggagctgagcaggctgagatctgacgacacggccgtgtattactgtgcgagaggagcgtttgattacttctactactacgctatggacgtctggggccacgggaccacggtcaccgtctcctca

SEQ ID NO: 31798 - protein, 122 aa, Artificial Sequence
  Description of Artificial Sequence: Synthetic polypeptide
QVHLVQSGAEVKKPGASVKVSCKASGYTFTGYYIHWVRQAPGQGLEWMGWINPKNGGTNYAQKFQGRVTMTRDASISTTYMELSRLRSDDTAVYYCARGAFDYFYYYAMDVWGHGTTVTVSS

SEQ ID NO: 31799 - DNA, 390 bp, Artificial Sequence
  Description of Artificial Sequence: Synthetic polynucleotide
caggtgcagctggtggagtctgggggaggcgtggtccagcctggggggtccctgagactctcctgtgcagcgtctggattcaccttcagtacctatggcatgcactgggtccgcctggctccaggcaaggggctggagtgggtggcagttatatggtatgatggaagtaataaatactatgcagactccgtgaagggccgattcaccatctccagagacatttcccagaacacgctgtatctgcaaatgaacagcctgagagccgaggacacggctgtgtattactgtgcgagagataaccactattgtagtagtaccagctgctccccatactactactacttcggtatggacgtctggggccaagggaccacggtcaccgtctcctca

SEQ ID NO: 31800 - protein, 130 aa, Artificial Sequence
  Description of Artificial Sequence: Synthetic polypeptide
QVQLVESGGGVVQPGGSLRLSCAASGFTFSTYGMHWVRLAPGKGLEWVAVIWYDGSNKYYADSVKGRFTISRDISQNTLYLQMNSLRAEDTAVYYCARDNHYCSSTSCSPYYYYFGMDVWGQGTTVTVSS

SEQ ID NO: 31801 - DNA, 387 bp, Artificial Sequence
  Description of Artificial Sequence: Synthetic polynucleotide
caggtgcagttggtggagtctgggggaggcgtggtccagcctgggaggtccctgagactctcctgtgaagcgtctggattcatcttcagtagctatggcatgcactgggtccgccaggctccaggcaaggggctggagtgggtggcagttatgtggtatgatggaggtaataaagactatgcagactccgtgaagggccgattcaccatctccagagacaattccaagaacacgctgtatctgcaaatgaacagcctgagagccgaggacacggctgtgtattactgtgcgagagatcgggaatattgtactagtaccagctgcccttactactactactacggtatggacgtctggggccaagggaccacggtcaccgtctcctca

SEQ ID NO: 31802 - protein, 129 aa, Artificial Sequence
  Description of Artificial Sequence: Synthetic polypeptide
QVQLVESGGGVVQPGRSLRLSCEASGFIFSSYGMHWVRQAPGKGLEWVAVMWYDGGNKDYADSVKGRFTISRDNSKNTLYLQMNSLRAEDTAVYYCARDREYCTSTSCPYYYYYGMDVWGQGTTVTVSS

SEQ ID NO: 31803 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactttatgcactgggtgcgacaggcccctggacaagggcttgagtggatgggatggatcaaccctaacagtggtgacacaaactatgcacagaagtttcagggcagggtcaccatgaccagggacacgtccctcaacacagcctacatggagctgagcaggctgagatctgacgacacggccatttattactgtgcgagagggacttactatggttcggggagttattttaacgaacttgactcctggggccagggaaccctggtcaccgtctcctca

SEQ ID NO: 31804 - protein, 124 aa, Artificial Sequence
  Description of Artificial Sequence: Synthetic polypeptide
QVQLVQSGAEVKKPGASVKVSCKASGYTFTGYFMHWVRQAPGQGLEWMGWINPNSGDTNYAQKFQGRVTMTRDTSLNTAYMELSRLRSDDTAIYYCARGTYYGSGSYFNELDSWGQGTLVTVSS

SEQ ID NO: 31805 - DNA, 372 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaaggacttgagtggatgggatggatcaaccctaacagtggaggcacaaactatgcacagaagtttcaggacagggtcaccatgaccagggacacgtccatcagcacagcccacatggagctgagcaggctgagatctgacgacacggccgtgtattattgtgcgagaggatattactatggttcggggagttattataactggttcgactcctggggccagggaaccctggtcaccgtctcctca

SEQ ID NO: 31806 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQDRVTMTRDTSISTAHMELSRLRSDDTAVYYCARGYYYGSGSYYNWFDSWGQGTLVTVSS

SEQ ID NO: 31807 - DNA, 366 bp, Artificial Sequence
  Description of Artificial Sequence: Synthetic polynucleotide
caggtgcaactggtgcagtctggggctgaggtgaagaagcctggggcctcagtgaaagtctcctgcaaggcttctggatacaccttcaccggctactatatacactgggtgcgacaggcccctggacaagggcttgagtggatgggatggatcaaccctaacagtggtggcacaaactatgcacggaagtttcagggcagggtcaccatgaccagggacacgtccatcagcacagcctacatggagctgagcagactgagatctgacgacacggccgtgtattactgtgcgagaggagcgtttgattactactactactacgctttggacgtctggggccaagggaccacggtcaccgtctcctca

SEQ ID NO: 31808 - protein, 122 aa, Artificial Sequence
  Description of Artificial Sequence: Synthetic polypeptide
QVQLVQSGAEVKKPGASVKVSCKASGYTFTGYYIHWVRQAPGQGLEWMGWINPNSGGTNYARKFQGRVTMTRDTSISTAYMELSRLRSDDTAVYYCARGAFDYYYYYALDVWGQGTTVTVSS

SEQ ID NO: 31809 - DNA, 372 bp, Artificial Sequence
  Description of Artificial Sequence: Synthetic polynucleotide
caggtgcaactggtgcagtctggggctgaggtgaagaagcctggggcctcagtgaaggtctcctgcaaggcttctggatacaccttcaccggctactttatgcactgggtgcgacaggcccctggacaagggcttgagtggatgggttggatcaaccctaacagtggtgacacaaactatgcacagaagtttcagggcagggtcaccatgaccagggacacgtccctcagcacagcctacatggagctgagcaggctgagatctgacgacacggccatttattactgtgcgagagggacttactatggttcggggagttattttaacgaacttgactcctggggccagggaaccctggtcaccgtctcctca

SEQ ID NO: 31810 - protein, 124 aa, Artificial Sequence
  Description of Artificial Sequence: Synthetic polypeptide
QVQLVQSGAEVKKPGASVKVSCKASGYTFTGYFMHWVRQAPGQGLEWMGWINPNSGDTNYAQKFQGRVTMTRDTSLSTAYMELSRLRSDDTAIYYCARGTYYGSGSYFNELDSWGQGTLVTVSS

SEQ ID NO: 31811 - DNA, 366 bp, Artificial Sequence
  Description of Artificial Sequence: Synthetic polynucleotide
caggtgcaattggtgcagtctggggctgaggtgaagaagcctggggcctcagtgaaggtctcctgcaaggcttctggatacaccttcaccggctactatatgcactgggtgcgacaggcccctggacaagggcttgagcggatgggatggatcaaccctaagagtggtggcacaaactttgcacagaagtttcagggcagggtcaccatgaccagggacacgtccatcagcacagcctacatggaactgagcaggctgagatctgacgacacggccgtgtattactgcgcgagaggagcgtttgattacttctactactacggtatggacgtctggggccaagggaccacggtcaccgtctcctca

SEQ ID NO: 31812 - protein, 122 aa, Artificial Sequence
  Description of Artificial Sequence: Synthetic polypeptide
QVQLVQSGAEVKKPGASVKVSCKASGYTFTGYYMHWVRQAPGQGLERMGWINPKSGGTNFAQKFQGRVTMTRDTSISTAYMELSRLRSDDTAVYYCARGAFDYFYYYGMDVWGQGTTVTVSS

SEQ ID NO: 31813 - DNA, 384 bp, Artificial Sequence; identical to SEQ ID NO: 28795
  Description of Artificial Sequence: Synthetic polynucleotide

SEQ ID NO: 31814 - protein, 128 aa, Artificial Sequence; identical to SEQ ID NO: 28796
  Description of Artificial Sequence: Synthetic polypeptide

SEQ ID NO: 31815 - DNA, 366 bp, Artificial Sequence
  Description of Artificial Sequence: Synthetic polynucleotide
caggtgcaattggtgcagtctggggctgaggtgaagaagcctggggcctcagtgaaggtctcctgcaaggcttctggatacaccttcaccggctactatatgcactgggtgcgacaggcccctggacaagggcttgagcggatgggatggatcaaccctaagagtggtggcacaaactatgcacagaagtttcagggcagggtcaccatgaccagggacacgtccatcagcacagcctacatggagctgagcaggctgagatctgacgacacggccgtgtattactgcgcgagaggagcgtttgattacttctactactacggtatggacgtctggggccaagggaccacggtcaccgtctcctca

SEQ ID NO: 31816 - protein, 122 aa, Artificial Sequence
  Description of Artificial Sequence: Synthetic polypeptide
QVQLVQSGAEVKKPGASVKVSCKASGYTFTGYYMHWVRQAPGQGLERMGWINPKSGGTNYAQKFQGRVTMTRDTSISTAYMELSRLRSDDTAVYYCARGAFDYFYYYGMDVWGQGTTVTVSS

SEQ ID NO: 31817 - DNA, 357 bp, Artificial Sequence; identical to SEQ ID NO: 28231
  Description of Artificial Sequence: Synthetic polynucleotide

SEQ ID NO: 31818 - protein, 119 aa, Artificial Sequence; identical to SEQ ID NO: 28232
  Description of Artificial Sequence: Synthetic polypeptide

SEQ ID NO: 31819 - DNA, 366 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcagctattagtggtcgtggtggtaacacattctacgcagactccgtgaagggccggttcaccatctccagagacaattccaagaacacgctgtatctgcaaatgaacagcctgagagccgaggacacggccgtatattactgtgcgaaaagagagacgtataactggaactacgaagggtttgactactggggccagggaaccctggtcaccgtctcctca

SEQ ID NO: 31820 - protein, 122 aa, Artificial Sequence
  Description of Artificial Sequence: Synthetic polypeptide
EVQLLESGGGLVQPGGSLRLSCAASGFTFSSYAMNWVRQAPGKGLEWVSAISGRGGNTFYADSVKGRFTISRDNSKNTLYLQMNSLRAEDTAVYYCAKRETYNWNYEGFDYWGQGTLVTVSS

SEQ ID NO: 31821 - DNA, 345 bp, Artificial Sequence; identical to SEQ ID NO: 29355
  Description of Artificial Sequence: Synthetic polynucleotide

SEQ ID NO: 31822 - protein, 115 aa, Artificial Sequence; identical to SEQ ID NO: 29356
  Description of Artificial Sequence: Synthetic polypeptide

SEQ ID NO: 31823 - DNA, 345 bp, Artificial Sequence
  Description of Artificial Sequence: Synthetic polynucleotide
gaggtgcacctggtggagtctgggggaggcctggtcaagcctggggggtccctgagactctcctgtgcagcctctggattcaccttcagtagctatagcatgaactgggtccgccaggctccagggaaggggctggagtgggtctcatccattagtggtagtagtacttacatatactacgcagactcagtgaagggccgattcaccatctccagagacaacgccaagaactcactgtatctgcaaatgaacagcctgagagccgaggacacggctgtgtattactgtgcgagaactggggtctttgactactggggccagggaaccctggtcaccgtctcctca

SEQ ID NO: 31824 - protein, 115 aa, Artificial Sequence
  Description of Artificial Sequence: Synthetic polypeptide
EVHLVESGGGLVKPGGSLRLSCAASGFTFSSYSMNWVRQAPGKGLEWVSSISGSSTYIYYADSVKGRFTISRDNAKNSLYLQMNSLRAEDTAVYYCARTGVFDYWGQGTLVTVSS

SEQ ID NO: 31825 - DNA, 345 bp, Artificial Sequence
  Description of Artificial Sequence: Synthetic polynucleotide
gaggtgcagctggtggaatctgggggaggcctggtcaagccgggggggtccctgagactctcctgtgcagcctctggattcaccttcagtaactatagaatgaactgggtccgccagggtccagggaaggggctggagtggatctcatccattagtggtagtagtactgacatatactacgcagactcagtgaagggccgattcaccatctccagagacaacgccaagaactcactgtatctgcaaatgaacagcctgagagccgaggacacggctgtgtattactgtgcgagagtggcctcctttgactactggggccagggaaccctggtcaccgtctcctca

SEQ ID NO: 31826 - protein, 115 aa, Artificial Sequence
  Description of Artificial Sequence: Synthetic polypeptide
EVQLVESGGGLVKPGGSLRLSCAASGFTFSNYRMNWVRQGPGKGLEWISSISGSSTDIYYADSVKGRFTISRDNAKNSLYLQMNSLRAEDTAVYYCARVASFDYWGQGTLVTVSS

SEQ ID NO: 31827 - DNA, 351 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctttggcatgaactgggtccgccaggctccagggaaggggctggagtgggtctcatctattagtagtagtactggttacatatacaacgcagactcagtgaagggccgattcaccatctccagagacaacgccaagaactcactgtatctgcaaatgaacagcctgagagccgaagacacggctgtgtattactgtgcgagaacctatagtgggagcctggacgtctggggccaagggaccacggtcaccgtctcctca

SEQ ID NO: 31828 - protein, 117 aa, Artificial Sequence
  Description of Artificial Sequence: Synthetic polypeptide
EVQLVESGGGLVKPGGSLRLSCAASGFTFSSFGMNWVRQAPGKGLEWVSSISSSTGYIYNADSVKGRFTISRDNAKNSLYLQMNSLRAEDTAVYYCARTYSGSLDVWGQGTTVTVSS

SEQ ID NO: 31829 - DNA, 363 bp, Artificial Sequence
  Description of Artificial Sequence: Synthetic polynucleotide
gaggtgcagctgttggagtctgggggaggcttggtacagcctggggggtccctgagactctcctgtgcagcctctggattcccctttagcagctatgccatgagctgggtccgccaggctccagggaaggggctggagtgggtctcagctattagtggtagtggtggtaacacattctacgcagactccgtgaagggccggttcaccatctccagagacaattccaagaacacgctgtatctgcaaatgaacagcctgagagccgaggacacggccgtatattactgtgcgaaatttttcggtgtagtgggagtcgggtgctttgactactggggccagggaaccctggtcaccgtctcctca

SEQ ID NO: 31830 - protein, 121 aa, Artificial Sequence
  Description of Artificial Sequence: Synthetic polypeptide
EVQLLESGGGLVQPGGSLRLSCAASGFPFSSYAMSWVRQAPGKGLEWVSAISGSGGNTFYADSVKGRFTISRDNSKNTLYLQMNSLRAEDTAVYYCAKFFGVVGVGCFDYWGQGTLVTVSS

SEQ ID NO: 31831 - DNA, 351 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagggggttcgagggggttcgacccctggggccagggaaccctggtcaccgtctcctca

SEQ ID NO: 31832 - protein, 117 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGGSRGFDPWGQGTLVTVSS

SEQ ID NO: 31833 - DNA, 363 bp, Artificial Sequence
  Description of Artificial Sequence: Synthetic polynucleotide
gaggtgcagatgttggagtctgggggaggcttgggacagtcgggggggtccctgagactctcctgtacagcctctggattcaccttcaccacttctgccatgagctgggtccgccaggctccagggaaggggctggagtgggtctcagctattagtggtagtggtgctaacacattctacgcagactccgtgaagggccggttcaccgtcaccagagacaattccaagaacacgctgtatctgcaaatgaacagcctgacagccgaggacacggccgtttattattgtgtgaaagttatagcagtggctggagggcactttttcgacccctggggccagggaaccctggtcaccgtctcctca

SEQ ID NO: 31834 - protein, 121 aa, Artificial Sequence
  Description of Artificial Sequence: Synthetic polypeptide
EVQMLESGGGLGQSGGSLRLSCTASGFTFTTSAMSWVRQAPGKGLEWVSAISGSGANTFYADSVKGRFTVTRDNSKNTLYLQMNSLTAEDTAVYYCVKVIAVAGGHFFDPWGQGTLVTVSS

SEQ ID NO: 31835 - DNA, 351 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacaataatggcacaaactatgcacagaagtttcagggcagggtcaccatgaccagggacacgtccatcagcacagcctacatggagctgagcaggctgagatctgacgacacggccgtgtattactgtgcgagagatgggagcagtggctttgactactggggccagggaaccctggtcaccgtctcctca

SEQ ID NO: 31836 - protein, 117 aa, Artificial Sequence
  Description of Artificial Sequence: Synthetic polypeptide
QVQLVQSGAEVKKPGASVKVSCKASGYTFTGYYMHWVRQAPGQGLEWMGWINPNNNGTNYAQKFQGRVTMTRDTSISTAYMELSRLRSDDTAVYYCARDGSSGFDYWGQGTLVTVSS

SEQ ID NO: 31837 - DNA, 372 bp, Artificial Sequence; identical to SEQ ID NO: 29771
  Description of Artificial Sequence: Synthetic polynucleotide

SEQ ID NO: 31838 - protein, 124 aa, Artificial Sequence; identical to SEQ ID NO: 29772
  Description of Artificial Sequence: Synthetic polypeptide

SEQ ID NO: 31839 - DNA, 363 bp, Artificial Sequence
  Description of Artificial Sequence: Synthetic polynucleotide
gaggtgcaactgttggagtctgggggaggcttggtacagcctggggggtccctgagactctcctgtgcagcctctggattcacctttagcagctatgccatgagctgggtccgccaggctccagggaaggggctggagtgggtctcagttattagtggtggtggtagtagtacatactacgcagactccgtgaagggccggttcaccatctccagagacaattccaagaacacgctgtatctgcaaatgaacagcctgagagccgaggacacggccgtatattactgtgcgaaatggcgaggtaaccccactgactacggtatggacgtctggggccaagggaccacggtcaccgtctcctca

SEQ ID NO: 31840 - protein, 121 aa, Artificial Sequence; identical to SEQ ID NO: 31304
  Description of Artificial Sequence: Synthetic polypeptide

SEQ ID NO: 31841 - DNA, 363 bp, Artificial Sequence; identical to SEQ ID NO: 31327
  Description of Artificial Sequence: Synthetic polynucleotide

SEQ ID NO: 31842 - protein, 121 aa, Artificial Sequence; identical to SEQ ID NO: 31304
  Description of Artificial Sequence: Synthetic polypeptide

SEQ ID NO: 31843 - DNA, 378 bp, Artificial Sequence
  Description of Artificial Sequence: Synthetic polynucleotide
caggtgcagctgggggaggctgggggaggcgtggtccagcctgggaggtccctgagactctcctgtgcagcgtctggattcaccttcagtcgctatggcatgcactgggtccgccaggctccaggcaaggggctggagtgggtggcttttatatggtatgatggaagtgagaactactatgcagactccgtgaagggccgattcaccatctccagagtcaattccaggaacacgctgtatctgcaaatgaacagcctgagagccgaggacacggctgtgtattactgtgcgagagatcgggtggagggttcggggactccctactactactacggtatggacgtctggggccaagggaccacggtcaccgtctcctca

SEQ ID NO: 31844 - protein, 126 aa, Artificial Sequence
  Description of Artificial Sequence: Synthetic polypeptide
QVQLGEAGGGVVQPGRSLRLSCAASGFTFSRYGMHWVRQAPGKGLEWVAFIWYDGSENYYADSVKGRFTISRVNSRNTLYLQMNSLRAEDTAVYYCARDRVEGSGTPYYYYGMDVWGQGTTVTVSS

SEQ ID NO: 31845 - DNA, 378 bp, Artificial Sequence; identical to SEQ ID NO: 31843
  Description of Artificial Sequence: Synthetic polynucleotide

SEQ ID NO: 31846 - protein, 126 aa, Artificial Sequence; identical to SEQ ID NO: 31844
  Description of Artificial Sequence: Synthetic polypeptide

SEQ ID NO: 31847 - DNA, 387 bp, Artificial Sequence
  Description of Artificial Sequence: Synthetic polynucleotide
caggtacacctggtggagtctgggggaggcgtggtccagcctgggaggtccctgagactctcctgtgcagcgtctggattcaccatcagtacctatggcatgcactgggtccgccagggtccaggcaaggggctggagtgggtggcagttatatggtatggtggaagtgatacagactatgcagactccgtgaggggccgattcaccatctccagagacatttccaagaacacgctgtatctgcaaatgaacagcctgagagccgaggacacggctgtgtattactgtgcgagagatcgggattattgtagtggtggtaactgcccttactactactactacggtatggacgtctggggccaagggaccacggtcaccgtctcctca

SEQ ID NO: 31848 - protein, 129 aa, Artificial Sequence
  Description of Artificial Sequence: Synthetic polypeptide
QVHLVESGGGVVQPGRSLRLSCAASGFTISTYGMHWVRQGPGKGLEWVAVIWYGGSDTDYADSVRGRFTISRDISKNTLYLQMNSLRAEDTAVYYCARDRDYCSGGNCPYYYYYGMDVWGQGTTVTVSS

SEQ ID NO: 31849 - DNA, 366 bp, Artificial Sequence
  Description of Artificial Sequence: Synthetic polynucleotide
caggtgcagttggtgcagtctggggctgaggtgaagaagcctggggcctcagtgaaggtctcctgcaaggcttctggatacaccttcaccggctactttatgcactgggtgcgacaggcccctggacaagggcttgagtggatgggatggatcaagcctaaaagcggtggcacaaactgtgcacagaagtttcagggcagggtcaccatgaccagggacacgtccagcagcacagcctacatggagctgagcaggctgacatctgacgacacggccgtgtattactgtgcgagagggggggctacggtgactacgtggggggtctttgactactggggccagggaaccctggtcaccgtctcctca

SEQ ID NO: 31850 - protein, 122 aa, Artificial Sequence
  Description of Artificial Sequence: Synthetic polypeptide
QVQLVQSGAEVKKPGASVKVSCKASGYTFTGYFMHWVRQAPGQGLEWMGWIKPKSGGTNCAQKFQGRVTMTRDTSSSTAYMELSRLTSDDTAVYYCARGGATVTTWGVFDYWGQGTLVTVSS

SEQ ID NO: 31851 - DNA, 363 bp, Artificial Sequence
  Description of Artificial Sequence: Synthetic polynucleotide
gaggtgcaactggtggagtctgggggaggctcggtacagcctggggggtccctgagactctcctgtgcagcctctggattcaccttcagtagctatagcatgaactgggtccgccaggctccagggaaggggctggagtgggtttcatacattagcagtagtggtagtaccaaatactacgcagactctgtggagggccgattcaccatctccagagacaatgccaagaattcactggatctgcaaatgaacagcctgagagacgaggacacggctgtgtatcgctgtgcgagagatagtaggaaggggttctactacggtctggacgtctggggccaagggaccacggtcaccgtctcctca

SEQ ID NO: 31852 - protein, 121 aa, Artificial Sequence
  Description of Artificial Sequence: Synthetic polypeptide
EVQLVESGGGSVQPGGSLRLSCAASGFTFSSYSMNWVRQAPGKGLEWVSYISSSGSTKYYADSVEGRFTISRDNAKNSLDLQMNSLRDEDTAVYRCARDSRKGFYYGLDVWGQGTTVTVSS

SEQ ID NO: 31853 - DNA, 366 bp, Artificial Sequence
  Description of Artificial Sequence: Synthetic polynucleotide
caggtgcagctggtgcagtctggggctgaggtgaagaagcctggggcctcagtgagggtctcctgcaaggcttctggatacaccttcaccggctactttatgcactgggtgcgacaggcccctggacaagggcttgagtggatgggatggatcaagcctaagagtggtggcacaaactctgcacagaggtttcagggcagggtcaccatgaccagggacacgtccatcaacacagcctacatggagctgaacaggctgagatctgacgacacggccgtatattactgtgcgagaggggggactacggtggctacgtggggggtctttgactactggggccagggaaccctggtcaccgtctcctca

SEQ ID NO: 31854 - protein, 122 aa, Artificial Sequence; identical to SEQ ID NO: 30468
  Description of Artificial Sequence: Synthetic polypeptide

SEQ ID NO: 31855 - DNA, 366 bp, Artificial Sequence
  Description of Artificial Sequence: Synthetic polynucleotide
caggtgcagctggtacagtctggggctgaggtgaagaagcctggggcctcagtgcgggtctcctgcaaggcttctggatacaccttcaccggctactttatgcactgggtgcgacaggcccctggacaagggcttgagtggatgggatggatcaagcctaagagtggtggcacaaactctgcacagaggtttcagggcagggtcaccatgaccagggacacgtccatcaacacagcctacatggagctgaactggctgagatctgacgacacggccgtatattactgtgcgagaggggggactacggtggctacgtggggggtctttgactactggggccagggaaccctggtcaccgtctcctca

SEQ ID NO: 31856 - protein, 122 aa, Artificial Sequence
  Description of Artificial Sequence: Synthetic polypeptide
QVQLVQSGAEVKKPGASVRVSCKASGYTFTGYFMHWVRQAPGQGLEWMGWIKPKSGGTNSAQRFQGRVTMTRDTSINTAYMELNWLRSDDTAVYYCARGGTTVATWGVFDYWGQGTLVTVSS

SEQ ID NO: 31857 - DNA, 384 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatggactgggtccgccaggctccaggcaaggggctggagtgggtggcaattatatggtttgatggaagtaataaatactatgcagactccgtgaagggccgattcaccatctccagagacaattccaagaacacgctgtatctgcaaatgaacagcctgagagccgaggacacggctgtgtattactgtgcgagagcatattgtggtggtgactgctatttcccccatctccattactacggtatggacgtctggggccaagggaccacggtcaccgtctcctca

SEQ ID NO: 31858 - protein, 128 aa, Artificial Sequence
  Description of Artificial Sequence: Synthetic polypeptide
QVQLVESGGGVVQPGRSLRLSCAASGFTFSSYGMDWVRQAPGKGLEWVAIIWFDGSNKYYADSVKGRFTISRDNSKNTLYLQMNSLRAEDTAVYYCARAYCGGDCYFPHLHYYGMDVWGQGTTVTVSS

SEQ ID NO: 31859 - DNA, 366 bp, Artificial Sequence
  Description of Artificial Sequence: Synthetic polynucleotide
caggtacagctggtgcagtctggggctgaggtgaagaagcctggggcctcagtgaaggtctcctgcaaggcttctggatacaccttcaccggctactttatgcactgggtgcgacaggcccctggacaagggcttgagtggatgggatggatcaagcctaaaagtggtggcacaaactgtgcacagaagtttcagggcagggtcaccatgaccagggacacgtccatcagcacagcctacatggaactgagcaggctgagatctgacgacacggccgtgtattattgtgtgagaggggggactacggtgactacgtggggggtctttgactactggggccagggaaccatggtcaccgtctcctca

SEQ ID NO: 31860 - protein, 122 aa, Artificial Sequence
  Description of Artificial Sequence: Synthetic polypeptide
QVQLVQSGAEVKKPGASVKVSCKASGYTFTGYFMHWVRQAPGQGLEWMGWIKPKSGGTNCAQKFQGRVTMTRDTSISTAYMELSRLRSDDTAVYYCVRGGTTVTTWGVFDYWGQGTMVTVSS

SEQ ID NO: 31861 - DNA, 360 bp, Artificial Sequence
  Description of Artificial Sequence: Synthetic polynucleotide
caggtgcaggtggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaatagaaactatgcagactccgtgaagggccgattcaccatctccagagacaattccaagaacacgctgtatctgcaaatgaacagcctgagagtcgaggacacggctgtgtattactgtgcgagagatcggtctaagggttacgacggtatggacgtctggggccaagggaccacggtcaccgtctcctca

SEQ ID NO: 31862 - protein, 120 aa, Artificial Sequence
  Description of Artificial Sequence: Synthetic polypeptide
QVQVVESGGGVVQPGRSLRLSCAASGFTFSSYGMHWVRQAPGKGLEWVAVIWYDGSNRNYADSVKGRFTISRDNSKNTLYLQMNSLRVEDTAVYYCARDRSKGYDGMDVWGQGTTVTVSS

SEQ ID NO: 31863 - DNA, 351 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtgactatggcatgcactgggtccgccaggctccaggcaaggggctggagtgggtggcagttatatggtatgatggaggtaatacacattatacagactccgtgaagggccgattcaccatctccagagacaattccaagaacacgctgtatctgcaaatgaacagcctgagagccgaggacacggctgtatattactgtgcgagagaagtgggttggcttgatgactactggggccagggaaccctggtcaccgtctcctca

SEQ ID NO: 31864 - protein, 117 aa, Artificial Sequence
  Description of Artificial Sequence: Synthetic polypeptide
QVQLVESGGGVVQPGRSLRLSCAASGFTFSDYGMHWVRQAPGKGLEWVAVIWYDGGNTHYTDSVKGRFTISRDNSKNTLYLQMNSLRAEDTAVYYCAREVGWLDDYWGQGTLVTVSS

SEQ ID NO: 31865 - DNA, 372 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagctggtggaactacggggagctactactacaacggtatggacgtctggggccaagggaccacggtcaccgtctcctca

SEQ ID NO: 31866 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKAGGTTGSYYYNGMDVWGQGTTVTVSS

SEQ ID NO: 31867 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctagattcaccttcagtgactatgtcatgcactgggtccgccaggctccaggcaaggggctggagtgggtggcagttatatggtatgatggaagtaataaatactatgtagactccgtgaagggccgattcaccatctccagagacaattccaggaacacgctgtatctgcaaatgaacagcctgagagccgaggacacggctgtatattactgtgcgagagaacggtatagcagtggcttgtacgactacggtatggacgtctggggccaagggaccacggtcaccgtctcctca

SEQ ID NO: 31868 - protein, 123 aa, Artificial Sequence
  Description of Artificial Sequence: Synthetic polypeptide
QVQLVESGGGVVQPGRSLRLSCAASRFTFSDYVMHWVRQAPGKGLEWVAVIWYDGSNKYYVDSVKGRFTISRDNSRNTLYLQMNSLRAEDTAVYYCARERYSSGLYDYGMDVWGQGTTVTVSS

SEQ ID NO: 31869 - DNA, 369 bp, Artificial Sequence; identical to SEQ ID NO: 28155
  Description of Artificial Sequence: Synthetic polynucleotide

SEQ ID NO: 31870 - protein, 123 aa, Artificial Sequence; identical to SEQ ID NO: 28156
  Description of Artificial Sequence: Synthetic polypeptide

SEQ ID NO: 31871 - DNA, 357 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccaattctccctgaaactgaactctgtgactgccgcggacacggccgtgtatttctgtgcgagagattcccctgacagggggtttgactactggggccagggaaccctggtcaccgtctcctca

SEQ ID NO: 31872 - protein, 119 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLNSVTAADTAVYFCARDSPDRGFDYWGQGTLVTVSS

SEQ ID NO: 31873 - DNA, 363 bp, Artificial Sequence
  Description of Artificial Sequence: Synthetic polynucleotide
caggtgcagctggtggaatctgggggaggcgtggtccagcctgggaggtccctgagactctcctgtgcagcctctggattcaccttcagtagctatggcatgcactgggtccgccaggctccaggcaaggggctggagtgggtgacaattatatcatatagtggaagtaataaatactatgcagactccgtgaagggccgattcaccatctccagagacaattccaagaacacgctgtatctgcaaatgaacagcctgagagctgaggacacggctgtgtattactgtgcgagacggggatacagctatggcgggtacggtatggacgtctggggccaagggaccacggtcaccgtctcctca

SEQ ID NO: 31874 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVTIISYSGSNKYYADSVKGRFTISRDNSKNTLYLQMNSLRAEDTAVYYCARRGYSYGGYGMDVWGQGTTVTVSS

SEQ ID NO: 31875 - DNA, 372 bp, Artificial Sequence
  Description of Artificial Sequence: Synthetic polynucleotide
caggtgcaggtacagcagtggggcgcaggactgttgaagcattcggagaccctgtccctcacctgcgctgtctatggtgggtccttcactgattactactggagctggatccgccagcccccagggaaggggctggagtggattggggaaatcaatcatagtggagacaccaactacaacccgtccctcaagagtcgagtcaccatatcagtagacacgtccaagaaccagttctccctgaagctgagttctgtgaccgccgcggacacggctgtgtattactgtgcgagagagtttccatatagtggaagctacctctactactacggtatggacgtctggggccaagggaccacggtcaccgtctcctca

SEQ ID NO: 31876 - protein, 124 aa, Artificial Sequence
  Description of Artificial Sequence: Synthetic polypeptide
QVQVQQWGAGLLKHSETLSLTCAVYGGSFTDYYWSWIRQPPGKGLEWIGEINHSGDTNYNPSLKSRVTISVDTSKNQFSLKLSSVTAADTAVYYCAREFPYSGSYLYYYGMDVWGQGTTVTVSS

SEQ ID NO: 31877 - DNA, 354 bp, Artificial Sequence; identical to SEQ ID NO: 29721
  Description of Artificial Sequence: Synthetic polynucleotide

SEQ ID NO: 31878 - protein, 118 aa, Artificial Sequence; identical to SEQ ID NO: 29722
  Description of Artificial Sequence: Synthetic polypeptide

SEQ ID NO: 31879 - DNA, 345 bp, Artificial Sequence; identical to SEQ ID NO: 29737
  Description of Artificial Sequence: Synthetic polynucleotide

SEQ ID NO: 31880 - protein, 115 aa, Artificial Sequence; identical to SEQ ID NO: 29738
  Description of Artificial Sequence: Synthetic polypeptide

SEQ ID NO: 31881 - DNA, 366 bp, Artificial Sequence
  Description of Artificial Sequence: Synthetic polynucleotide
caggtgcaactggtggagtctgggggaggcgtggtccagcctgggaggtccctgagactctcctgtgcagcgtctggattcaccttcagtagttatggcatgcattgggtccgccaggctccaggcaaggggctggagtgggtggcagttatatggtatgatggaagtgataaatactatgcagactccgtgaagggccgattcaccatctccagagacaattccaagaacacgctgtatctgcaaatgaacagcctgagagccgaggacacggctgtgtattactgtgcgagagatcggttagtgggagctacggttgatgcttttgatatctggggccaagggacaatggtcaccgtctcttca

SEQ ID NO: 31882 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSDKYYADSVKGRFTISRDNSKNTLYLQMNSLRAEDTAVYYCARDRLVGATVDAFDIWGQGTMVTVSS

SEQ ID NO: 31883 - DNA, 345 bp, Artificial Sequence; identical to SEQ ID NO: 29737
  Description of Artificial Sequence: Synthetic polynucleotide

SEQ ID NO: 31884 - protein, 115 aa, Artificial Sequence; identical to SEQ ID NO: 29738
  Description of Artificial Sequence: Synthetic polypeptide

SEQ ID NO: 31885 - DNA, 345 bp, Artificial Sequence; identical to SEQ ID NO: 29737
  Description of Artificial Sequence: Synthetic polynucleotide

SEQ ID NO: 31886 - protein, 115 aa, Artificial Sequence; identical to SEQ ID NO: 29738
  Description of Artificial Sequence: Synthetic polypeptide

SEQ ID NO: 31887 - DNA, 354 bp, Artificial Sequence; identical to SEQ ID NO: 31559
  Description of Artificial Sequence: Synthetic polynucleotide

SEQ ID NO: 31888 - protein, 118 aa, Artificial Sequence; identical to SEQ ID NO: 31560
  Description of Artificial Sequence: Synthetic polypeptide

SEQ ID NO: 31889 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtggttgctactggagctggatccgccagcccccagggaaggggctggagtggattggggaaatcaatcatagtggaaggaccaactacaacccgtccctcaagagtcgagtcaccatatcagtagacacgtccgagaaccagttctccctgaagctgagctctgtgaccgccgcggacacggctgtgtattactgtgcgagagactacggtgggcttgactactggggccagggaaccctggtcaccgtctcctca

SEQ ID NO: 31890 - protein, 115 aa, Artificial Sequence; identical to SEQ ID NO: 29790
  Description of Artificial Sequence: Synthetic polypeptide

SEQ ID NO: 31891 - DNA, 345 bp, Artificial Sequence; identical to SEQ ID NO: 29737
  Description of Artificial Sequence: Synthetic polynucleotide

SEQ ID NO: 31892 - protein, 115 aa, Artificial Sequence; identical to SEQ ID NO: 29738
  Description of Artificial Sequence: Synthetic polypeptide

SEQ ID NO: 31893 - DNA, 357 bp, Artificial Sequence; identical to SEQ ID NO: 28187
  Description of Artificial Sequence: Synthetic polynucleotide

SEQ ID NO: 31894 - protein, 119 aa, Artificial Sequence; identical to SEQ ID NO: 28188
  Description of Artificial Sequence: Synthetic polypeptide

SEQ ID NO: 31895 - DNA, 345 bp, Artificial Sequence; identical to SEQ ID NO: 29737
  Description of Artificial Sequence: Synthetic polynucleotide

SEQ ID NO: 31896 - protein, 115 aa, Artificial Sequence; identical to SEQ ID NO: 29738
  Description of Artificial Sequence: Synthetic polypeptide

SEQ ID NO: 31897 - DNA, 354 bp, Artificial Sequence; identical to SEQ ID NO: 29879
  Description of Artificial Sequence: Synthetic polynucleotide

SEQ ID NO: 31898 - protein, 118 aa, Artificial Sequence; identical to SEQ ID NO: 29880
  Description of Artificial Sequence: Synthetic polypeptide

SEQ ID NO: 31899 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctgacagtggtaacacaggctttgcacagaagttccagggcagagtcaccatgaccaggaacacctccataagcacagcctacatggagctgagcagcctgagatctgaggacacggccgtgtattactgtgcggtttccagtggctggtactggttcgacccctggggccagggaaccctggtcaccgtctcctca

SEQ ID NO: 31900 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPDSGNTGFAQKFQGRVTMTRNTSISTAYMELSSLRSEDTAVYYCAVSSGWYWFDPWGQGTLVTVSS

SEQ ID NO: 31901 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatatcaactgggtgcgacaggccactggacaagggcttgagtggatgggatggatgaaccctaacagtggtaacataggctatgcacagaagttccagggcagagtcaccatgaccaggaacacctccataagcacagcctacatggagctgagcagcctgagatctgaggacacggccgtgtattactgtgcgattagcagtggctggtactggttcgacccctggggccagggaaccctggtcaccgtctcctca

SEQ ID NO: 31902 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMNPNSGNIGYAQKFQGRVTMTRNTSISTAYMELSSLRSEDTAVYYCAISSGWYWFDPWGQGTLVTVSS

SEQ ID NO: 31903 - DNA, 345 bp, Artificial Sequence; identical to SEQ ID NO: 29737
  Description of Artificial Sequence: Synthetic polynucleotide

SEQ ID NO: 31904 - protein, 115 aa, Artificial Sequence; identical to SEQ ID NO: 29738
  Description of Artificial Sequence: Synthetic polypeptide

SEQ ID NO: 31905 - DNA, 375 bp, Artificial Sequence; identical to SEQ ID NO: 29783
  Description of Artificial Sequence: Synthetic polynucleotide

SEQ ID NO: 31906 - protein, 125 aa, Artificial Sequence; identical to SEQ ID NO: 29784
  Description of Artificial Sequence: Synthetic polypeptide

SEQ ID NO: 31907 - DNA, 354 bp, Artificial Sequence; identical to SEQ ID NO: 31559
  Description of Artificial Sequence: Synthetic polynucleotide

SEQ ID NO: 31908 - protein, 118 aa, Artificial Sequence; identical to SEQ ID NO: 31560
  Description of Artificial Sequence: Synthetic polypeptide

SEQ ID NO: 31909 - DNA, 354 bp, Artificial Sequence; identical to SEQ ID NO: 29723
  Description of Artificial Sequence: Synthetic polynucleotide

SEQ ID NO: 31910 - protein, 118 aa, Artificial Sequence; identical to SEQ ID NO: 29724
  Description of Artificial Sequence: Synthetic polypeptide

SEQ ID NO: 31911 - DNA, 354 bp, Artificial Sequence
  Description of Artificial Sequence: Synthetic polynucleotide
gaggtgcacctggtggagtctgggggaggcttggtaaagcctggggggtcccttagactctcctgtgcagcctctggattcactttcagtaacgcctggatgaactgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagtgggagctactacggactactggggccagggaaccctggtcaccgtctcctca

SEQ ID NO: 31912 - protein, 118 aa, Artificial Sequence
  Description of Artificial Sequence: Synthetic polypeptide
EVHLVESGGGLVKPGGSLRLSCAASGFTFSNAWMNWVRQAPGKGLEWVGRIKSKTDGGTTDYAAPVKGRFTISRDDSKNTLYLQMNSLKTEDTAVYYCTTVGATTDYWGQGTLVTVSS

SEQ ID NO: 31913 - DNA, 357 bp, Artificial Sequence; identical to SEQ ID NO: 31721
  Description of Artificial Sequence: Synthetic polynucleotide

SEQ ID NO: 31914 - protein, 119 aa, Artificial Sequence; identical to SEQ ID NO: 31722
  Description of Artificial Sequence: Synthetic polypeptide

SEQ ID NO: 31915 - DNA, 354 bp, Artificial Sequence
  Description of Artificial Sequence: Synthetic polynucleotide
caggtgctcctggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtagcacaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31916 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMYPNSGSTGYAQKFQGRVTMTRDTSISTAYMELSSLRSEDTAVYYCASSSGWYYFDYWGQGTLVTVSS

SEQ ID NO: 31917 - DNA, 354 bp, Artificial Sequence
  Description of Artificial Sequence: Synthetic polynucleotide
caggtgctcctggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtaacgcaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31918 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMYPNSGNAGYAQKFQGRVTMTRDTSISTAYMELSSLRSEDTAVYYCASSSGWYYFDYWGQGTLVTVSS

SEQ ID NO: 31919 - DNA, 354 bp, Artificial Sequence
  Description of Artificial Sequence: Synthetic polynucleotide
caggtgctcctggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtaacgtaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31920 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMYPNSGNVGYAQKFQGRVTMTRDTSISTAYMELSSLRSEDTAVYYCASSSGWYYFDYWGQGTLVTVSS

SEQ ID NO: 31921 - DNA, 354 bp, Artificial Sequence
  Description of Artificial Sequence: Synthetic polynucleotide
caggtgctcctggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtcaaacaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31922 - protein, 118 aa, Artificial Sequence
  Description of Artificial Sequence: Synthetic polypeptide
QVLLVQSGAEVKRPGASVKVSCKASGYTFTNYDINWVRQATGQGLEWMGWMYPNSGQTGYAQKFQGRVTMTRDTSISTAYMELSSLRSEDTAVYYCASSSGWYYFDYWGQGTLVTVSS

SEQ ID NO: 31923 - DNA, 354 bp, Artificial Sequence
  Description of Artificial Sequence: Synthetic polynucleotide
caggtgcaactggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtagcacaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31924 - protein, 118 aa, Artificial Sequence
  Description of Artificial Sequence: Synthetic polypeptide
QVQLVQSGAEVKRPGASVKVSCKASGYTFTNYDINWVRQATGQGLEWMGWMYPNSGSTGYAQKFQGRVTMTRDTSISTAYMELSSLRSEDTAVYYCASSSGWYYFDYWGQGTLVTVSS

SEQ ID NO: 31925 - DNA, 354 bp, Artificial Sequence
  Description of Artificial Sequence: Synthetic polynucleotide
caggtgcaactggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtaacgcaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31926 - protein, 118 aa, Artificial Sequence
  Description of Artificial Sequence: Synthetic polypeptide
QVQLVQSGAEVKRPGASVKVSCKASGYTFTNYDINWVRQATGQGLEWMGWMYPNSGNAGYAQKFQGRVTMTRDTSISTAYMELSSLRSEDTAVYYCASSSGWYYFDYWGQGTLVTVSS

SEQ ID NO: 31927 - DNA, 354 bp, Artificial Sequence
  Description of Artificial Sequence: Synthetic polynucleotide
caggtgcaactggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtaacgtaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31928 - protein, 118 aa, Artificial Sequence
  Description of Artificial Sequence: Synthetic polypeptide
QVQLVQSGAEVKRPGASVKVSCKASGYTFTNYDINWVRQATGQGLEWMGWMYPNSGNVGYAQKFQGRVTMTRDTSISTAYMELSSLRSEDTAVYYCASSSGWYYFDYWGQGTLVTVSS

SEQ ID NO: 31929 - DNA, 354 bp, Artificial Sequence
  Description of Artificial Sequence: Synthetic polynucleotide
caggtgcaactggtgcagtctggggctgaggtgaagaggcctggggcctcagtgaaggtcagctgcaaggcttctggatacaccttcaccaattatgatattaattgggtgcgacaggccactggacaagggcttgagtggatgggatggatgtaccctaacagtggtcaaacaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31930 - protein, 118 aa, Artificial Sequence
  Description of Artificial Sequence: Synthetic polypeptide
QVQLVQSGAEVKRPGASVKVSCKASGYTFTNYDINWVRQATGQGLEWMGWMYPNSGQTGYAQKFQGRVTMTRDTSISTAYMELSSLRSEDTAVYYCASSSGWYYFDYWGQGTLVTVSS

SEQ ID NO: 31931 - DNA, 354 bp, Artificial Sequence; identical to SEQ ID NO: 31915
  Description of Artificial Sequence: Synthetic polynucleotide

SEQ ID NO: 31932 - protein, 118 aa, Artificial Sequence; identical to SEQ ID NO: 31916
  Description of Artificial Sequence: Synthetic polypeptide

SEQ ID NO: 31933 - DNA, 354 bp, Artificial Sequence
  Description of Artificial Sequence: Synthetic polynucleotide
caggtgcaactggtgcagtctggggctgaggtgaagaggcctggggcctcagtgaaggtcagctgcaaggcttctggatacaccttcaccaattatgatattaattgggtgcgacaggcccctggacaagggcttgagtggatgggatggatgtaccctaacagtggtagcacaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31934 - protein, 118 aa, Artificial Sequence
  Description of Artificial Sequence: Synthetic polypeptide
QVQLVQSGAEVKRPGASVKVSCKASGYTFTNYDINWVRQAPGQGLEWMGWMYPNSGSTGYAQKFQGRVTMTRDTSISTAYMELSSLRSEDTAVYYCASSSGWYYFDYWGQGTLVTVSS

SEQ ID NO: 31935 - DNA, 354 bp, Artificial Sequence
  Description of Artificial Sequence: Synthetic polynucleotide
caggtgctcctggtgcagtctggggctgaggtgaagaggcctggggcctcagtgaaggtcagctgcaaggcttctggatacaccttcaccaattatgatattaattgggtgcgacaggcccctggacaagggcttgagtggatgggatggatgtaccctaacagtggtcaaacaggctatgcacagaaattccagggcagagtcaccatgaccagggacacctccatcagcacagcctacatggagctgagcagcctgagatctgaggacacggccgtctattactgtgcgagtagcagtggctggtactactttgactactggggccagggaaccctggtcaccgtgtcctca

SEQ ID NO: 31936 - protein, 118 aa, Artificial Sequence
  Description of Artificial Sequence: Synthetic polypeptide
QVLLVQSGAEVKRPGASVKVSCKASGYTFTNYDINWVRQAPGQGLEWMGWMYPNSGQTGYAQKFQGRVTMTRDTSISTAYMELSSLRSEDTAVYYCASSSGWYYFDYWGQGTLVTVSS

SEQ ID NO: 31937 - DNA, 354 bp, Artificial Sequence; identical to SEQ ID NO: 31925
  Description of Artificial Sequence: Synthetic polynucleotide

SEQ ID NO: 31938 - protein, 118 aa, Artificial Sequence; identical to SEQ ID NO: 31926
  Description of Artificial Sequence: Synthetic polypeptide

SEQ ID NO: 31939 - DNA, 354 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31940 - protein, 118 aa, Artificial Sequence; identical to SEQ ID NO: 29172
  Description of Artificial Sequence: Synthetic polypeptide

SEQ ID NO: 31941 - DNA, 354 bp, Artificial Sequence; identical to SEQ ID NO: 31939
  Description of Artificial Sequence: Synthetic polynucleotide

SEQ ID NO: 31942 - protein, 118 aa, Artificial Sequence; identical to SEQ ID NO: 29172
  Description of Artificial Sequence: Synthetic polypeptide

SEQ ID NO: 31943 - DNA, 354 bp, Artificial Sequence; identical to SEQ ID NO: 31939
  Description of Artificial Sequence: Synthetic polynucleotide

SEQ ID NO: 31944 - protein, 118 aa, Artificial Sequence; identical to SEQ ID NO: 29172
  Description of Artificial Sequence: Synthetic polypeptide

SEQ ID NO: 31945 - DNA, 354 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttcaccaattatgatatcaactgggtgcgacaggccactggacaagggcttgagtggatgggatggatgcaccctaacagtggtaacgcaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31946 - protein, 118 aa, Artificial Sequence
  Description of Artificial Sequence: Synthetic polypeptide
QVQLVQSGTEVKKPGASVKVSCKASGYTFTNYDINWVRQATGQGLEWMGWMHPNSGNAGYAQKFQGRVTLTRDTSISTAYMELSSLRSEDTAVYYCASSSGWYYFDYWGQGTLVTVSS

SEQ ID NO: 31947 - DNA, 354 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttcaccaattatgatatcaactgggtgcgacaggccactggacaagggcttgagtggatgggatggatgcaccctaacagtggtagcacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31948 - protein, 118 aa, Artificial Sequence
  Description of Artificial Sequence: Synthetic polypeptide
QVQLVQSGTEVKKPGASVKVSCKASGYTFTNYDINWVRQATGQGLEWMGWMHPNSGSTGYAQKFQGRVTLTRDTSISTAYMELSSLRSEDTAVYYCASSSGWYYFDYWGQGTLVTVSS

SEQ ID NO: 31949 - DNA, 354 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttcaccaattatgatatcaactgggtgcgacaggccactggacaagggcttgagtggatgggatggatgcaccctaacagtggtcaaacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31950 - protein, 118 aa, Artificial Sequence
  Description of Artificial Sequence: Synthetic polypeptide
QVQLVQSGTEVKKPGASVKVSCKASGYTFTNYDINWVRQATGQGLEWMGWMHPNSGQTGYAQKFQGRVTLTRDTSISTAYMELSSLRSEDTAVYYCASSSGWYYFDYWGQGTLVTVSS

SEQ ID NO: 31951 - DNA, 354 bp, Artificial Sequence; identical to SEQ ID NO: 31949
  Description of Artificial Sequence: Synthetic polynucleotide

SEQ ID NO: 31952 - protein, 118 aa, Artificial Sequence; identical to SEQ ID NO: 31950
  Description of Artificial Sequence: Synthetic polypeptide

SEQ ID NO: 31953 - DNA, 354 bp, Artificial Sequence; identical to SEQ ID NO: 31945
  Description of Artificial Sequence: Synthetic polynucleotide

SEQ ID NO: 31954 - protein, 118 aa, Artificial Sequence; identical to SEQ ID NO: 31946
  Description of Artificial Sequence: Synthetic polypeptide

SEQ ID NO: 31955 - DNA, 354 bp, Artificial Sequence; identical to SEQ ID NO: 31949
  Description of Artificial Sequence: Synthetic polynucleotide

SEQ ID NO: 31956 - protein, 118 aa, Artificial Sequence; identical to SEQ ID NO: 31950
  Description of Artificial Sequence: Synthetic polypeptide

SEQ ID NO: 31957 - DNA, 354 bp, Artificial Sequence; identical to SEQ ID NO: 31945
  Description of Artificial Sequence: Synthetic polynucleotide

SEQ ID NO: 31958 - protein, 118 aa, Artificial Sequence; identical to SEQ ID NO: 31946
  Description of Artificial Sequence: Synthetic polypeptide

SEQ ID NO: 31959 - DNA, 354 bp, Artificial Sequence; identical to SEQ ID NO: 31949
  Description of Artificial Sequence: Synthetic polynucleotide

SEQ ID NO: 31960 - protein, 118 aa, Artificial Sequence; identical to SEQ ID NO: 31950
  Description of Artificial Sequence: Synthetic polypeptide

SEQ ID NO: 31961 - DNA, 354 bp, Artificial Sequence; identical to SEQ ID NO: 31947
  Description of Artificial Sequence: Synthetic polynucleotide

SEQ ID NO: 31962 - protein, 118 aa, Artificial Sequence; identical to SEQ ID NO: 31948
  Description of Artificial Sequence: Synthetic polypeptide

SEQ ID NO: 31963 - DNA, 354 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcaccaattatgatatcaactgggtgcgacaggccactggacaagggcttgagtggatgggatggatgcaccctaacagtggtaacacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31964 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGNTGYAQKFQGRVTLTRDTSISTAYMELSSLRSEDTAVYYCASSSGWYYFDYWGQGTLVTVSS

SEQ ID NO: 31965 - DNA, 354 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcaccaattatgatatcaactgggtgcgacaggcccctggacaagggcttgagtggatgggatggatgcaccctaacagtggtaacacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31966 - protein, 118 aa, Artificial Sequence
  Description of Artificial Sequence: Synthetic polypeptide
QVQLVQSGAEVKKPGASVKVSCKASGYTFTNYDINWVRQAPGQGLEWMGWMHPNSGNTGYAQKFQGRVTLTRDTSISTAYMELSSLRSEDTAVYYCASSSGWYYFDYWGQGTLVTVSS

SEQ ID NO: 31967 - DNA, 354 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcaccaattatgatatcaactgggtgcgacaggccactggacaagggcttgagtggatgggatggatgcaccctaacagtggtcaaacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31968 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPNSGQTGYAQKFQGRVTLTRDTSISTAYMELSSLRSEDTAVYYCASSSGWYYFDYWGQGTLVTVSS

SEQ ID NO: 31969 - DNA, 354 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcaccaattatgatatcaactgggtgcgacaggcccctggacaagggcttgagtggatgggatggatgcaccctaacagtggtcaaacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31970 - protein, 118 aa, Artificial Sequence
  Description of Artificial Sequence: Synthetic polypeptide
QVQLVQSGAEVKKPGASVKVSCKASGYTFTNYDINWVRQAPGQGLEWMGWMHPNSGQTGYAQKFQGRVTLTRDTSISTAYMELSSLRSEDTAVYYCASSSGWYYFDYWGQGTLVTVSS

SEQ ID NO: 31971 - DNA, 354 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcaccaattatgatatcaactgggtgcgacaggcccctggacaagggcttgagtggatgggatggatgcaccctaacagtggtagcacaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31972 - protein, 118 aa, Artificial Sequence
  Description of Artificial Sequence: Synthetic polypeptide
QVQLVQSGAEVKKPGASVKVSCKASGYTFTNYDINWVRQAPGQGLEWMGWMHPNSGSTGYAQKFQGRVTLTRDTSISTAYMELSSLRSEDTAVYYCASSSGWYYFDYWGQGTLVTVSS

SEQ ID NO: 31973 - DNA, 354 bp, Artificial Sequence
  Description of Artificial Sequence: Synthetic polynucleotide
caggtgcagctggtgcagtctgggggtgaggtgaagaagcctggggcctcagtgaaggtgtcctgcaaggcttctggatacaccttcaccaattatgatatcaactgggtgcgacaggccgaaggacaagggcttgagtggatgggatggatgcaccctaacagtggtaacgaaggctatgcacagaagttccagggcagagtcaccttgaccagggacacctccatcagcacagcctacatggaactgagcagcctgagatctgaggacacggccgtgtattactgtgcgagtagcagtggctggtactactttgactactggggccagggaaccctggtcaccgtgtcctca

SEQ ID NO: 31974 - protein, 118 aa, Artificial Sequence
  Description of Artificial Sequence: Synthetic polypeptide
QVQLVQSGGEVKKPGASVKVSCKASGYTFTNYDINWVRQAEGQGLEWMGWMHPNSGNEGYAQKFQGRVTLTRDTSISTAYMELSSLRSEDTAVYYCASSSGWYYFDYWGQGTLVTVSS

SEQ ID NO: 31975 - DNA, 351 bp, Artificial Sequence
  Description of Artificial Sequence: Synthetic polynucleotide
caggtgcagctggtacagtctggggctgaggtgaagaagcctggggcctcagtgaaggtcagctgcaaggcttctggatacaccttcaccgactactatttgcactgggtgcgacaggcccctggacaaggtcttgagtggatgggatggatccaccctaacagtggtggcacaaactatgcacagaagtttcagggcagggtcaccatgaccagggacacgtccatcagcacagcctacatggagctgagcagtctgagatctgacgacacggccgtgtattactgtgcgagagatggtaccagctcgtttgactactggggccagggaaccctggtcaccgtgtcctca

SEQ ID NO: 31976 - protein, 117 aa, Artificial Sequence
  Description of Artificial Sequence: Synthetic polypeptide
QVQLVQSGAEVKKPGASVKVSCKASGYTFTDYYLHWVRQAPGQGLEWMGWIHPNSGGTNYAQKFQGRVTMTRDTSISTAYMELSSLRSDDTAVYYCARDGTSSFDYWGQGTLVTVSS

SEQ ID NO: 31977 - DNA, 351 bp, Artificial Sequence; identical to SEQ ID NO: 31975
  Description of Artificial Sequence: Synthetic polynucleotide

SEQ ID NO: 31978 - protein, 117 aa, Artificial Sequence; identical to SEQ ID NO: 31976
  Description of Artificial Sequence: Synthetic polypeptide

SEQ ID NO: 31979 - DNA, 351 bp, Artificial Sequence; identical to SEQ ID NO: 31975
  Description of Artificial Sequence: Synthetic polynucleotide

SEQ ID NO: 31980 - protein, 117 aa, Artificial Sequence; identical to SEQ ID NO: 31976
  Description of Artificial Sequence: Synthetic polypeptide

SEQ ID NO: 31981 - DNA, 351 bp, Artificial Sequence
  Description of Artificial Sequence: Synthetic polynucleotide
caggtgcagctggtacagtctggggctgaggtgaagaagcctggggcctcagtgaaggtcagctgcaaggcttctggatacaccttcaccgactactatttgcactgggtgcgacaggcccctggacaaggtcttgagtggatgggatggatccaccctaacagtggtggcacaaactatgcacagaagtttcagggcagggtcaccatgaccagggacacgtccatcagcacagcctacatggagctgagcagtctgagatctgacgacacggccgtgtattactgtgcgagagatgctaccagctcgtttgactactggggccagggaaccctggtcaccgtgtcctca

SEQ ID NO: 31982 - protein, 117 aa, Artificial Sequence
  Description of Artificial Sequence: Synthetic polypeptide
QVQLVQSGAEVKKPGASVKVSCKASGYTFTDYYLHWVRQAPGQGLEWMGWIHPNSGGTNYAQKFQGRVTMTRDTSISTAYMELSSLRSDDTAVYYCARDATSSFDYWGQGTLVTVSS

SEQ ID NO: 31983 - DNA, 351 bp, Artificial Sequence
  Description of Artificial Sequence: Synthetic polynucleotide
caggtgcagctggtacagtctggggctgaggtgaagaagcctggggcctcagtgaaggtcagctgcaaggcttctggatacaccttcaccgactactatttgcactgggtgcgacaggcccctggacaaggtcttgagtggatgggatggatccaccctaacagtggtggcacaaactatgcacagaagtttcagggcagggtcaccatgaccagggacacgtccatcagcacagcctacatggagctgagcagtctgagatctgacgacacggccgtgtattactgtgcgagaagtggtaccagctcgtttgactactggggccagggaaccctggtcaccgtgtcctca

SEQ ID NO: 31984 - protein, 117 aa, Artificial Sequence
  Description of Artificial Sequence: Synthetic polypeptide
QVQLVQSGAEVKKPGASVKVSCKASGYTFTDYYLHWVRQAPGQGLEWMGWIHPNSGGTNYAQKFQGRVTMTRDTSISTAYMELSSLRSDDTAVYYCARSGTSSFDYWGQGTLVTVSS

SEQ ID NO: 31985 - DNA, 351 bp, Artificial Sequence; identical to SEQ ID NO: 31983
  Description of Artificial Sequence: Synthetic polynucleotide

SEQ ID NO: 31986 - protein, 117 aa, Artificial Sequence; identical to SEQ ID NO: 31984
  Description of Artificial Sequence: Synthetic polypeptide

SEQ ID NO: 31987 - DNA, 351 bp, Artificial Sequence; identical to SEQ ID NO: 31981
  Description of Artificial Sequence: Synthetic polynucleotide

SEQ ID NO: 31988 - protein, 117 aa, Artificial Sequence; identical to SEQ ID NO: 31982
  Description of Artificial Sequence: Synthetic polypeptide

SEQ ID NO: 31989 - DNA, 351 bp, Artificial Sequence; identical to SEQ ID NO: 31981
  Description of Artificial Sequence: Synthetic polynucleotide

SEQ ID NO: 31990 - protein, 117 aa, Artificial Sequence; identical to SEQ ID NO: 31982
  Description of Artificial Sequence: Synthetic polypeptide

SEQ ID NO: 31991 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatgcaagtaataaatactatgcagactccgtgaagggccgattcaccatctccagagacaattccaagaacacgctgtatctgcaaatgaacagcctgagagccgaggacacggctgtgtattactgtacgagagaggtatatagcagtggctggtacgactacggtatggacgtctggggccaagggaccacggtcaccgtgtcctca

SEQ ID NO: 31992 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDASNKYYADSVKGRFTISRDNSKNTLYLQMNSLRAEDTAVYYCTREVYSSGWYDYGMDVWGQGTTVTVSS

SEQ ID NO: 31993 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatggaagtaataaatactatgcagaatccgtgaagggccgattcaccatctccagagacaattccaagaacacgctgtatctgcaaatgaacagcctgagagccgaggacacggctgtgtattactgtacgagagaggtatatagcagtggctggtacgactacggtatggacgtctggggccaagggaccacggtcaccgtgtcctca

SEQ ID NO: 31994 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYAESVKGRFTISRDNSKNTLYLQMNSLRAEDTAVYYCTREVYSSGWYDYGMDVWGQGTTVTVSS

SEQ ID NO: 31995 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatggaagtaataaatactatgcaggctccgtgaagggccgattcaccatctccagagacaattccaagaacacgctgtatctgcaaatgaacagcctgagagccgaggacacggctgtgtattactgtacgagagaggtatatagcagtggctggtacgactacggtatggacgtctggggccaagggaccacggtcaccgtgtcctca

SEQ ID NO: 31996 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYAGSVKGRFTISRDNSKNTLYLQMNSLRAEDTAVYYCTREVYSSGWYDYGMDVWGQGTTVTVSS

SEQ ID NO: 31997 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatggaagtaataaatactatgcagacgccgtgaagggccgattcaccatctccagagacaattccaagaacacgctgtatctgcaaatgaacagcctgagagccgaggacacggctgtgtattactgtacgagagaggtatatagcagtggctggtacgactacggtatggacgtctggggccaagggaccacggtcaccgtgtcctca

SEQ ID NO: 31998 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADAVKGRFTISRDNSKNTLYLQMNSLRAEDTAVYYCTREVYSSGWYDYGMDVWGQGTTVTVSS

SEQ ID NO: 31999 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatgcaagtaataaatactatgcagaatccgtgaagggccgattcaccatctccagagacaattccaagaacacgctgtatctgcaaatgaacagcctgagagccgaggacacggctgtgtattactgtacgagagaggtatatagcagtggctggtacgactacggtatggacgtctggggccaagggaccacggtcaccgtgtcctca

SEQ ID NO: 32000 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDASNKYYAESVKGRFTISRDNSKNTLYLQMNSLRAEDTAVYYCTREVYSSGWYDYGMDVWGQGTTVTVSS

SEQ ID NO: 32001 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatgcaagtaataaatactatgcagacgccgtgaagggccgattcaccatctccagagacaattccaagaacacgctgtatctgcaaatgaacagcctgagagccgaggacacggctgtgtattactgtacgagagaggtatatagcagtggctggtacgactacggtatggacgtctggggccaagggaccacggtcaccgtgtcctca

SEQ ID NO: 32002 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDASNKYYADAVKGRFTISRDNSKNTLYLQMNSLRAEDTAVYYCTREVYSSGWYDYGMDVWGQGTTVTVSS

SEQ ID NO: 32003 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatgcaagtaataaatactatgcagactccgtgaagggccgattcaccatctccagagacaattccaagaacacgctgtatctgcaaatgaacagcctgagagccgaggacacggctgtgtattactgtacgagagaggtatatagcagtggctattacgactacggtatggacgtctggggccaagggaccacggtcaccgtgtcctca

SEQ ID NO: 32004 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDASNKYYADSVKGRFTISRDNSKNTLYLQMNSLRAEDTAVYYCTREVYSSGYYDYGMDVWGQGTTVTVSS

SEQ ID NO: 32005 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatgcaagtaataaatactatgcagactccgtgaagggccgattcaccatctccagagacaattccaagaacacgctgtatctgcaaatgaacagcctgagagccgaggacacggctgtgtattactgtacgagagaggtatatagcagtggcttctacgactacggtatggacgtctggggccaagggaccacggtcaccgtgtcctca

SEQ ID NO: 32006 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDASNKYYADSVKGRFTISRDNSKNTLYLQMNSLRAEDTAVYYCTREVYSSGFYDYGMDVWGQGTTVTVSS

SEQ ID NO: 32007 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatggaagtaataaatactatgcagaatccgtgaagggccgattcaccatctccagagacaattccaagaacacgctgtatctgcaaatgaacagcctgagagccgaggacacggctgtgtattactgtacgagagaggtatatagcagtggctattacgactacggtatggacgtctggggccaagggaccacggtcaccgtgtcctca

SEQ ID NO: 32008 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYAESVKGRFTISRDNSKNTLYLQMNSLRAEDTAVYYCTREVYSSGYYDYGMDVWGQGTTVTVSS

SEQ ID NO: 32009 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatggaagtaataaatactatgcagactccgtgaagggccgattcaccatctccagagacaattccaagaacacgctgtatctgcaaatgaacagcctgagagccgaggacacggctgtgtattactgtacgagagaggtatatagcagtggctattacgactacggtatggacgtctggggccaagggaccacggtcaccgtgtcctca

SEQ ID NO: 32010 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCTREVYSSGYYDYGMDVWGQGTTVTVSS

SEQ ID NO: 32011 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatggaagtaataaatactatgcagactccgtgaagggccgattcaccatctccagagacaattccaagaacacgctgtatctgcaaatgaacagcctgagagccgaggacacggctgtgtattactgtacgagagaggtatatagcagtggcttctacgactacggtatggacgtctggggccaagggaccacggtcaccgtgtcctca

SEQ ID NO: 32012 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCTREVYSSGFYDYGMDVWGQGTTVTVSS

SEQ ID NO: 32013 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatgcaagtaataaatactatgcagaatccgtgaagggccgattcaccatctccagagacaattccaagaacacgctgtatctgcaaatgaacagcctgagagccgaggacacggctgtgtattactgtacgagagaggtatatagcagtggctattacgactacggtatggacgtctggggccaagggaccacggtcaccgtgtcctca

SEQ ID NO: 32014 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDASNKYYAESVKGRFTISRDNSKNTLYLQMNSLRAEDTAVYYCTREVYSSGYYDYGMDVWGQGTTVTVSS

SEQ ID NO: 32015 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatgtcatgcactgggtccgccaggctccaggcaaggggctggagtgggtggcagttatctggtatgatgcaagtaataaatactatgcagacgccgtgaagggccgattcaccatctccagagacaattccaagaacacgctgtatctgcaaatgaacagcctgagagccgaggacacggctgtgtattactgtacgagagaggtatatagcagtggctattacgactacggtatggacgtctggggccaagggaccacggtcaccgtgtcctca

SEQ ID NO: 32016 - protein, 123 aa, Artificial Sequence
  Description of Artificial Sequence: Synthetic polypeptide
QVQLVESGGGVVQPGRSLRLSCAASGFTFSNYVMHWVRQAPGKGLEWVAVIWYDASNKYYADAVKGRFTISRDNSKNTLYLQMNSLRAEDTAVYYCTREVYSSGYYDYGMDVWGQGTTVTVSS

SEQ ID NO: 32017 - DNA, 369 bp, Artificial Sequence
  Description of Artificial Sequence: Synthetic polynucleotide
gaggtgcagctggtggagtctgggggaggcgtggtccagcctggggggtccctgagactctcctgtgcagcgtctggattcaccttcagtaactatgtcatgcactgggtccgccaggctccaggcaaggggctggagtgggtggcagttatctggtatgatggaagtaataaatactatgcagaatccgtgaagggccgattcaccatctccagagacaatgccaagaacacgctgtatctgcaaatgaacagcctgagagccgaggacacggctgtgtattactgtacgagagaggtatatagcagtggctggtacgactacggtatggacgtctggggccaagggaccacggtcaccgtgtcctca

SEQ ID NO: 32018 - protein, 123 aa, Artificial Sequence
  Description of Artificial Sequence: Synthetic polypeptide
EVQLVESGGGVVQPGGSLRLSCAASGFTFSNYVMHWVRQAPGKGLEWVAVIWYDGSNKYYAESVKGRFTISRDNAKNTLYLQMNSLRAEDTAVYYCTREVYSSGWYDYGMDVWGQGTTVTVSS

SEQ ID NO: 32019 - DNA, 354 bp, Artificial Sequence; identical to SEQ ID NO: 29181
  Description of Artificial Sequence: Synthetic polynucleotide

SEQ ID NO: 32020 - protein, 118 aa, Artificial Sequence; identical to SEQ ID NO: 29182
  Description of Artificial Sequence: Synthetic polypeptide

SEQ ID NO: 32021 - DNA, 354 bp, Artificial Sequence; identical to SEQ ID NO: 29181
  Description of Artificial Sequence: Synthetic polynucleotide

SEQ ID NO: 32022 - protein, 118 aa, Artificial Sequence; identical to SEQ ID NO: 29182
  Description of Artificial Sequence: Synthetic polypeptide

SEQ ID NO: 32023 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatagtggaagtaataaatactatgcagactccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32024 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHSGSNKYYADSVKGRFTISRDNSKNTLYLQMSSLRAEDTAVYYCARDLSMGGMDVWGQGTTVTVSS

SEQ ID NO: 32025 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgaaggaagtaataaatactatgcagactccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32026 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHEGSNKYYADSVKGRFTISRDNSKNTLYLQMSSLRAEDTAVYYCARDLSMGGMDVWGQGTTVTVSS

SEQ ID NO: 32027 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgatgcaagtaataaatactatgcagactccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32028 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHDASNKYYADSVKGRFTISRDNSKNTLYLQMSSLRAEDTAVYYCARDLSMGGMDVWGQGTTVTVSS

SEQ ID NO: 32029 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgatggaagtaataaatactatgcagaatccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32030 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHDGSNKYYAESVKGRFTISRDNSKNTLYLQMSSLRAEDTAVYYCARDLSMGGMDVWGQGTTVTVSS

SEQ ID NO: 32031 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgatggaagtaataaatactatgcagacgccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32032 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHDGSNKYYADAVKGRFTISRDNSKNTLYLQMSSLRAEDTAVYYCARDLSMGGMDVWGQGTTVTVSS

SEQ ID NO: 32033 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgaaggaagtaataaatactatgcagacgccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32034 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHEGSNKYYADAVKGRFTISRDNSKNTLYLQMSSLRAEDTAVYYCARDLSMGGMDVWGQGTTVTVSS

SEQ ID NO: 32035 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgaaggaagtaataaatactatgcagaatccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32036 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHEGSNKYYAESVKGRFTISRDNSKNTLYLQMSSLRAEDTAVYYCARDLSMGGMDVWGQGTTVTVSS

SEQ ID NO: 32037 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatagtggaagtaataaatactatgcagaatccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32038 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHSGSNKYYAESVKGRFTISRDNSKNTLYLQMSSLRAEDTAVYYCARDLSMGGMDVWGQGTTVTVSS

SEQ ID NO: 32039 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatagtggaagtaataaatactatgcagacgccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32040 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHSGSNKYYADAVKGRFTISRDNSKNTLYLQMSSLRAEDTAVYYCARDLSMGGMDVWGQGTTVTVSS

SEQ ID NO: 32041 - DNA, 354 bp, Artificial Sequence; identical to SEQ ID NO: 32023
  Description of Artificial Sequence: Synthetic polynucleotide

SEQ ID NO: 32042 - protein, 118 aa, Artificial Sequence; identical to SEQ ID NO: 32024
  Description of Artificial Sequence: Synthetic polypeptide

SEQ ID NO: 32043 - DNA, 354 bp, Artificial Sequence; identical to SEQ ID NO: 32029
  Description of Artificial Sequence: Synthetic polynucleotide

SEQ ID NO: 32044 - protein, 118 aa, Artificial Sequence; identical to SEQ ID NO: 32030
  Description of Artificial Sequence: Synthetic polypeptide

SEQ ID NO: 32045 - DNA, 354 bp, Artificial Sequence; identical to SEQ ID NO: 32037
  Description of Artificial Sequence: Synthetic polynucleotide

SEQ ID NO: 32046 - protein, 118 aa, Artificial Sequence; identical to SEQ ID NO: 32038
  Description of Artificial Sequence: Synthetic polypeptide

SEQ ID NO: 32047 - DNA, 354 bp, Artificial Sequence; identical to SEQ ID NO: 32023
  Description of Artificial Sequence: Synthetic polynucleotide

SEQ ID NO: 32048 - protein, 118 aa, Artificial Sequence; identical to SEQ ID NO: 32024
  Description of Artificial Sequence: Synthetic polypeptide

SEQ ID NO: 32049 - DNA, 354 bp, Artificial Sequence; identical to SEQ ID NO: 32037
  Description of Artificial Sequence: Synthetic polynucleotide

SEQ ID NO: 32050 - protein, 118 aa, Artificial Sequence; identical to SEQ ID NO: 32038
  Description of Artificial Sequence: Synthetic polypeptide

SEQ ID NO: 32051 - DNA, 354 bp, Artificial Sequence; identical to SEQ ID NO: 32033
  Description of Artificial Sequence: Synthetic polynucleotide

SEQ ID NO: 32052 - protein, 118 aa, Artificial Sequence; identical to SEQ ID NO: 32034
  Description of Artificial Sequence: Synthetic polypeptide

SEQ ID NO: 32053 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgatgcaagtaataaatactatgcagaatccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32054 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHDASNKYYAESVKGRFTISRDNSKNTLYLQMSSLRAEDTAVYYCARDLSMGGMDVWGQGTTVTVSS

SEQ ID NO: 32055 - DNA, 354 bp, Artificial Sequence
  Description of Artificial Sequence: Synthetic polynucleotide
gaggtgcagctggtggagtctgggggaggcgtggtccagcctggggggtccctgcgactctcctgtgcagcgtctggattcaccttcagtagctttggcatgcactgggtccgccaggctccaggcaaggggctggagtgggtggcaattatctggcatgatggaagtaataaatactatgcagaatccgtgaagggccgattcaccatctccagagacaatgccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32056 - protein, 118 aa, Artificial Sequence
  Description of Artificial Sequence: Synthetic polypeptide
EVQLVESGGGVVQPGGSLRLSCAASGFTFSSFGMHWVRQAPGKGLEWVAIIWHDGSNKYYAESVKGRFTISRDNAKNTLYLQMSSLRAEDTAVYYCARDLSMGGMDVWGQGTTVTVSS

SEQ ID NO: 32057 - DNA, 354 bp, Artificial Sequence
  Description of Artificial Sequence: Synthetic polynucleotide
gaggtgcagctggtggagtctgggggaggcgtggtccagcctggggggtccctgcgactctcctgtgcagcgtctggattcaccttcagtagctttggcatgcactgggtccgccaggctccaggcaaggggctggagtgggtggcaattatctggcatagtggaagtaataaatactatgcagaatccgtgaagggccgattcaccatctccagagacaatgccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32058 - protein, 118 aa, Artificial Sequence
  Description of Artificial Sequence: Synthetic polypeptide
EVQLVESGGGVVQPGGSLRLSCAASGFTFSSFGMHWVRQAPGKGLEWVAIIWHSGSNKYYAESVKGRFTISRDNAKNTLYLQMSSLRAEDTAVYYCARDLSMGGMDVWGQGTTVTVSS

SEQ ID NO: 32059 - DNA, 354 bp, Artificial Sequence
  Description of Artificial Sequence: Synthetic polynucleotide
gaggtgcagctggtggagtctgggggaggcgtggtccagcctggggggtccctgcgactctcctgtgcagcgtctggattcaccttcagtagctttggcatgcactgggtccgccaggctccaggcaaggggctggagtgggtggcaattatctggcatgaaggaagtaataaatactatgcagaatccgtgaagggccgattcaccatctccagagacaatgccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32060 - protein, 118 aa, Artificial Sequence
  Description of Artificial Sequence: Synthetic polypeptide
EVQLVESGGGVVQPGGSLRLSCAASGFTFSSFGMHWVRQAPGKGLEWVAIIWHEGSNKYYAESVKGRFTISRDNAKNTLYLQMSSLRAEDTAVYYCARDLSMGGMDVWGQGTTVTVSS

SEQ ID NO: 32061 - DNA, 363 bp, Artificial Sequence
  Description of Artificial Sequence: Synthetic polynucleotide
caggtgcagctgcaggagtcgggcccaggactggtgaagccttcacagaccctgtccctcaattgcactgtctctggtggctccatcagcaacagtggttactactggagctggatccgccagcacccagggaagggcctggaatggattgggtacagctattacagtgggagcacctactacaacccgtccctcaagagtcgaattaccatatcagtagacacgtctaacaaccagttctccctgaagctgagctctgtgactgccgcggacacggccgtgtattactgtgcgagagggggatataactggaaccatgcttttgatatctggggccaagggacaatggtcaccgtctcttca

SEQ ID NO: 32062 - protein, 121 aa, Artificial Sequence
  Description of Artificial Sequence: Synthetic polypeptide
QVQLQESGPGLVKPSQTLSLNCTVSGGSISNSGYYWSWIRQHPGKGLEWIGYSYYSGSTYYNPSLKSRITISVDTSNNQFSLKLSSVTAADTAVYYCARGGYNWNHAFDIWGQGTMVTVSS

SEQ ID NO: 32063 - DNA, 363 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccggctactatatacactgggtgcgacaggcccctggacaaggccttgagtggatgggatggatcaaccctaacagtggtggcacaaactatgcacagaagtttcagggcggggtcaccatgaccaggctcacgtccatcaacacagcctacatggacctgagcaggctgagatctgacgacacggccgtgtattactgtgcgagaggagggaattacttctacaaccacgttatggacgtctggggccaagggaccccggtcaccgtctcctca

SEQ ID NO: 32064 - protein, 121 aa, Artificial Sequence
  Description of Artificial Sequence: Synthetic polypeptide
QVQLVQSGAEVKKPGASVKVSCKASGYTFTGYYIHWVRQAPGQGLEWMGWINPNSGGTNYAQKFQGGVTMTRLTSINTAYMDLSRLRSDDTAVYYCARGGNYFYNHVMDVWGQGTPVTVSS

SEQ ID NO: 32065 - DNA, 363 bp, Artificial Sequence; identical to SEQ ID NO: 32063
  Description of Artificial Sequence: Synthetic polynucleotide

SEQ ID NO: 32066 - protein, 121 aa, Artificial Sequence; identical to SEQ ID NO: 32064
  Description of Artificial Sequence: Synthetic polypeptide

SEQ ID NO: 32067 - DNA, 354 bp, Artificial Sequence; identical to SEQ ID NO: 31921
  Description of Artificial Sequence: Synthetic polynucleotide

SEQ ID NO: 32068 - protein, 118 aa, Artificial Sequence; identical to SEQ ID NO: 31922
  Description of Artificial Sequence: Synthetic polypeptide

SEQ ID NO: 32069 - DNA, 351 bp, Artificial Sequence
  Description of Artificial Sequence: Synthetic polynucleotide
caggtgcagctggtacagtctggggctgaggtgaagaagcctggggcctcagtgaaggtcagctgcaaggcttctggatacaccttcaccgactactatttgcactgggtgcgacaggcccctggacaaggtcttgagtggatgggatggatccaccctaacagtggtggcacaaactatgcacagaagtttcagggcagggtcaccatgaccagggacacgtccatcagcacagcctacatggggctgagcagtctgagatctgacgacacggccgtgtattactgtgcgagagatgctaccagctcgtttgactactggggccagggaaccctggtcaccgtgtcctca

SEQ ID NO: 32070 - protein, 117 aa, Artificial Sequence
  Description of Artificial Sequence: Synthetic polypeptide
QVQLVQSGAEVKKPGASVKVSCKASGYTFTDYYLHWVRQAPGQGLEWMGWIHPNSGGTNYAQKFQGRVTMTRDTSISTAYMGLSSLRSDDTAVYYCARDATSSFDYWGQGTLVTVSS

SEQ ID NO: 32071 - DNA, 354 bp, Artificial Sequence
  Description of Artificial Sequence: Synthetic polynucleotide
caggtgcagctggtggagtctgggggaggcgtggtccagcctgggaggtccctgcgactctcctgtgcagcgtctggattcaccttcagtagctttggcatgcactgggtccgccaggctccaggcaaggggctggagtgggtggcaattatctggcatgatgcaagtaataaatactatgcagacgccgtgaagggccgattcaccatctccagagacaattccaaaaacacgctgtatctgcaaatgagcagcctgcgagccgaggacacggctgtgtattactgtgcgagagatctgagtatgggcggtatggacgtctggggccaagggaccacggtcaccgtgtcctca

SEQ ID NO: 32072 - protein, 118 aa, Artificial Sequence
  Description of Artificial Sequence: Synthetic polypeptide
QVQLVESGGGVVQPGRSLRLSCAASGFTFSSFGMHWVRQAPGKGLEWVAIIWHDASNKYYADAVKGRFTISRDNSKNTLYLQMSSLRAEDTAVYYCARDLSMGGMDVWGQGTTVTVSS

SEQ ID NO: 32073 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaagacttctggatacaccttcaccaattatgatatcaactgggtgcgacaggccactggacaagggcttgagtggatgggatggatgaaccctaacagtggtaacacaggctatgcacagaagttccaggtcagagtcaccatgaccaggaacacctccataagcacagcctacatggaggtgagcagcctgagatctgaggacacggccgtctattactgtgcgtatagcagtggctggtacatctttgactactggggccagggaaccctggtcaccgtctcttca

SEQ ID NO: 32074 - protein, 118 aa, Artificial Sequence
  Description of Artificial Sequence: Synthetic polypeptide
QVQLVQSGAEVKKPGASVKVSCKTSGYTFTNYDINWVRQATGQGLEWMGWMNPNSGNTGYAQKFQVRVTMTRNTSISTAYMEVSSLRSEDTAVYYCAYSSGWYIFDYWGQGTLVTVSS

SEQ ID NO: 32075 - DNA, 354 bp, Artificial Sequence; identical to SEQ ID NO: 29759
  Description of Artificial Sequence: Synthetic polynucleotide

SEQ ID NO: 32076 - protein, 118 aa, Artificial Sequence; identical to SEQ ID NO: 29760
  Description of Artificial Sequence: Synthetic polypeptide

SEQ ID NO: 32077 - DNA, 345 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcaggagctttagcttgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatgcgtatagccactactggggccagggaaccctggtcaccgtctcctca

SEQ ID NO: 32078 - protein, 115 aa, Artificial Sequence
  Description of Artificial Sequence: Synthetic polypeptide
EVQLVESGGGLVKPGGSLRLSCAASGFTFRSFSLNWVRQAPGKGLEWVSSISSSSSYIYYADSVKGRFTISRDNAKNSLYLQMNSLRAEDTAVYYCARDAYSHYWGQGTLVTVSS

SEQ ID NO: 32079 - DNA, 351 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtagttatagcatgaactgggtccgccaggctccagggaaggggctggagtgggtctcatccattagtggtagtagtagttacatatactacgcagactcagtgaagggccgattcaccatctccagagacaacgccaagaactcactgtatctgcaaatgaacagcctgagagccgaggacacggctgtgtatttctgtgcgagagggggttcgagggggttcgacccctggggccagggaaccctggtcaccgtctcctca

SEQ ID NO: 32080 - protein, 117 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYFCARGGSRGFDPWGQGTLVTVSS

SEQ ID NO: 32081 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcctccggattcatcttcagtagctatggcatgcactgggtccgccaggctccaggcaaggggctggagtgggtggcagttatatcacaagatggaattattagatactatgcagactccgtgaagggccgattcaccatctccagagacaattccaagaacacgctgtatctgcaaatgaacagcctgagagctgaggacacggctgtgtattactgtgcgagagatgtgaagcagtggctggtacggacctacggtatggacgtctggggccaagggaccacggtcaccgtctcctca

SEQ ID NO: 32082 - protein, 123 aa, Artificial Sequence
  Description of Artificial Sequence: Synthetic polypeptide
QVQLVESGGGVVQPGRSLRLSCAASGFIFSSYGMHWVRQAPGKGLEWVAVISQDGIIRYYADSVKGRFTISRDNSKNTLYLQMNSLRAEDTAVYYCARDVKQWLVRTYGMDVWGQGTTVTVSS

SEQ ID NO: 32083 - DNA, 387 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagttactatggcttgcactgggtccgccaggctccaggcaaggggctggagtgggtggcagttatatcatatgatggaagtaataaatattatgcagactccgtgaagggccgattcaccatctccagagacaattccaagaacacgctgtatctgcaaatgaacaacctgagagctgaggacacggctgtgttttactgtgcgagagaggatcgatattgtagtggtaccagctgcccctactactactactacggtatggacgtctggggccaagggaccacggtcaccgtctcctca

SEQ ID NO: 32084 - protein, 129 aa, Artificial Sequence
  Description of Artificial Sequence: Synthetic polypeptide
QVQLVESGGGVVQPGRSLRLSCAASGFTFSYYGLHWVRQAPGKGLEWVAVISYDGSNKYYADSVKGRFTISRDNSKNTLYLQMNNLRAEDTAVFYCAREDRYCSGTSCPYYYYYGMDVWGQGTTVTVSS

SEQ ID NO: 32085 - DNA, 366 bp, Artificial Sequence; identical to SEQ ID NO: 31475
  Description of Artificial Sequence: Synthetic polynucleotide

SEQ ID NO: 32086 - protein, 122 aa, Artificial Sequence; identical to SEQ ID NO: 31476
  Description of Artificial Sequence: Synthetic polypeptide

SEQ ID NO: 32087 - DNA, 366 bp, Artificial Sequence
  Description of Artificial Sequence: Synthetic polynucleotide
caggttcagctggtgcagtctggagctgaggtgaagaagcctggggcctcagtgaaggtctcctgcaaggcttctggttacacctttaacagctatggtatcagctgggtgcgactggcccctggacaagggtttgagtggatgggatggatcagcgcttataatggtaacacaaagaatgcacagaagctccagggcagagtcaccatgaccacagacacatccacgagcacagcctacatggagctgaggagcctgagatctgacgacacggccgtttattactgtgcgagacacgatttttggagtggttattataagggtatggacgtctggggccaagggaccacggtcaccgtctcctca

SEQ ID NO: 32088 - protein, 122 aa, Artificial Sequence
  Description of Artificial Sequence: Synthetic polypeptide
QVQLVQSGAEVKKPGASVKVSCKASGYTFNSYGISWVRLAPGQGFEWMGWISAYNGNTKNAQKLQGRVTMTTDTSTSTAYMELRSLRSDDTAVYYCARHDFWSGYYKGMDVWGQGTTVTVSS

SEQ ID NO: 32089 - DNA, 366 bp, Artificial Sequence
  Description of Artificial Sequence: Synthetic polynucleotide
caggttcagctggtgcagtctggagctgaggtgaagaagcctggggcctcagtgaaggtctcctgcaaggcttctggttacacctttaacagctatggtatcagctgggtgcgacaggcccctggacaagggcttgagtggatgggatggatcagcgcttataatggtaacacaaagtttgcacagaagctccagggcagagtcaccatgaccacagacacatccacgagcacagcctacatggaactgaggagcctgagatctgacgacacggccgtgtattactgtgcgagacacgatttttggagtggttattataagggtatggacgtctggggccaagggaccacggtcaccgtctcctca

SEQ ID NO: 32090 - protein, 122 aa, Artificial Sequence
  Description of Artificial Sequence: Synthetic polypeptide
QVQLVQSGAEVKKPGASVKVSCKASGYTFNSYGISWVRQAPGQGLEWMGWISAYNGNTKFAQKLQGRVTMTTDTSTSTAYMELRSLRSDDTAVYYCARHDFWSGYYKGMDVWGQGTTVTVSS

SEQ ID NO: 32091 - DNA, 387 bp, Artificial Sequence; identical to SEQ ID NO: 31567
  Description of Artificial Sequence: Synthetic polynucleotide

SEQ ID NO: 32092 - protein, 129 aa, Artificial Sequence; identical to SEQ ID NO: 31568
  Description of Artificial Sequence: Synthetic polypeptide

SEQ ID NO: 32093 - DNA, 381 bp, Artificial Sequence
  Description of Artificial Sequence: Synthetic polynucleotide
caggtgcagttggtgcagtctggggctgaggtgaagaagcctggggcctcagtgaaggtctcctgcaaggcttctggatacattttcaccggctactatatacactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgatcaggctgagatctgacgacacggccgtgtattattgtgcgagagaaaacgaaagtctagcaactcgtcctttctacgactactacggtatggacgtctggggccaagggaccacggtcaccgtctcctca

SEQ ID NO: 32094 - protein, 127 aa, Artificial Sequence
  Description of Artificial Sequence: Synthetic polypeptide
QVQLVQSGAEVKKPGASVKVSCKASGYIFTGYYIHWVRQAPGQGLEWMGWINPNSGGTNYAQKFQGRVTMTRDTSISTAYMELIRLRSDDTAVYYCARENESLATRPFYDYYGMDVWGQGTTVTVSS

SEQ ID NO: 32095 - DNA, 369 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcacctttagtgactatgtcatgcagtgggtccgccaggctccaggcaaggggctggagtgggtggcagttatatggtatgatggaagtaataaatactatgcagactccgtgaagggccgattcaccatctccagagacatttccaagaacacgctgtatctgcaaatgaacagcctgagagccgaggacacggctgtgtattactgtgcgagagaaccgtataatagtggctggtacgactacggtatggacgtctggggccaagggaccacggtcaccgtctcctca

SEQ ID NO: 32096 - protein, 123 aa, Artificial Sequence
  Description of Artificial Sequence: Synthetic polypeptide
QVQLVESGGGVVQPGRSLRLSCAASGFTFSDYVMQWVRQAPGKGLEWVAVIWYDGSNKYYADSVKGRFTISRDISKNTLYLQMNSLRAEDTAVYYCAREPYNSGWYDYGMDVWGQGTTVTVSS

SEQ ID NO: 32097 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggattcaccttccccaattatgatatcaactgggtgcgacaggccactggacaaggccttgagtggatgggatggatgcaccctaacagtggtaacacaggctatgcacagaagttccagggcagagtcaccatgaccaggaacacctccataagcacagcctacatggagctgagcagcctgagatctgaggacacggccgtgtattactgtgcgagtagcagtggctggtacttctttgactactggggccagggaaccctggtcaccgtctcctca

SEQ ID NO: 32098 - protein, 118 aa, Artificial Sequence
  Description of Artificial Sequence: Synthetic polypeptide
QVQLVQSGAEVKKPGASVKVSCKASGFTFPNYDINWVRQATGQGLEWMGWMHPNSGNTGYAQKFQGRVTMTRNTSISTAYMELSSLRSEDTAVYYCASSSGWYFFDYWGQGTLVTVSS

SEQ ID NO: 32099 - DNA, 372 bp, Artificial Sequence
  Description of Artificial Sequence: Synthetic polynucleotide
caggtgcagctgcaggagtcgggcccaggactggtgaagccttcggagaccctgtccctcacctgcactgtctctagtggctccgtcagcagtggtggttactactggagctggatccggcagcccccagggaagggactggagtggattgggtatatctattacagtgggaccaccatttacaacccctccctcaagagtcgagtcaccatatcagtagacacgtccaagaaccagttctccctgaagctgacctctgtgaccgttgcggacacggccgtgtattactgtgcgcgagacacgttttgctttgatggttgtggttatttctttgactcctggggccagggaaccctggtcaccgtctcctca

SEQ ID NO: 32100 - protein, 124 aa, Artificial Sequence
  Description of Artificial Sequence: Synthetic polypeptide
QVQLQESGPGLVKPSETLSLTCTVSSGSVSSGGYYWSWIRQPPGKGLEWIGYIYYSGTTIYNPSLKSRVTISVDTSKNQFSLKLTSVTVADTAVYYCARDTFCFDGCGYFFDSWGQGTLVTVSS

SEQ ID NO: 32101 - DNA, 360 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcatcttcagtagccatggcatgcactgggtccgccaggctccaggcaaggggctggagtgggtggcagttatatggtatgatggaagtaatgaacactatgcagactccgtgaagggccgattcaccatctccagagacaattccaagaacacgctgtatctgcaaatgaacagcctgagagccgaggacacggctgtttattactgtgcgagagatcaaggtgtggggtactacggtatggacgtctggggccaagggaccacggtcaccgtctcctca

SEQ ID NO: 32102 - protein, 120 aa, Artificial Sequence
  Description of Artificial Sequence: Synthetic polypeptide
QVQLVESGGGVVQPGRSLRLSCAASGFIFSSHGMHWVRQAPGKGLEWVAVIWYDGSNEHYADSVKGRFTISRDNSKNTLYLQMNSLRAEDTAVYYCARDQGVGYYGMDVWGQGTTVTVSS

SEQ ID NO: 32103 - DNA, 345 bp, Artificial Sequence
  Description of Artificial Sequence: Synthetic polynucleotide
caggtgcagctacagcagtggggcgcaggactgttgaagccttcggagaccctgtccctcacctgcgctgtctatggtgggtccttcagtgtttactattggagctggatccgccagcccccagggaaggggctggagtggattggggaaatcaatcatagtggaagcaccaactacaacccgtccctcaagagtcgagtcaccatttcactagacacgtccaagaaccagttctccctgaagctgagctctgtgaccgccgcggacacggctgtgtattactgtgcgagagactacggtgtctttgactactggggccagggaaccctggtcaccgtctcctca

SEQ ID NO: 32104 - protein, 115 aa, Artificial Sequence
  Description of Artificial Sequence: Synthetic polypeptide
QVQLQQWGAGLLKPSETLSLTCAVYGGSFSVYYWSWIRQPPGKGLEWIGEINHSGSTNYNPSLKSRVTISLDTSKNQFSLKLSSVTAADTAVYYCARDYGVFDYWGQGTLVTVSS

SEQ ID NO: 32105 - DNA, 354 bp, Artificial Sequence; identical to SEQ ID NO: 30067
  Description of Artificial Sequence: Synthetic polynucleotide

SEQ ID NO: 32106 - protein, 118 aa, Artificial Sequence; identical to SEQ ID NO: 30068
  Description of Artificial Sequence: Synthetic polypeptide

SEQ ID NO: 32107 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccaattatgatgtcaactgggtgcgacaggccactggacaagggcttgagtggatgggatggatgcaccctaacagtggtaacacaggctatgcacagaagttccagggcagagtcaccatgaccaggaacacctccacaagcacagcctacatggagctgagcagcctgagatctgaggactcggccgtgtattactgtgcgagtagcagtggctggtacctctttgactactggggccagggaaccctggtcaccgtctcctca

SEQ ID NO: 32108 - protein, 118 aa, Artificial Sequence
  Description of Artificial Sequence: Synthetic polypeptide
QVQLVQSGAEVKKPGASVKVSCKASGYTFTNYDVNWVRQATGQGLEWMGWMHPNSGNTGYAQKFQGRVTMTRNTSTSTAYMELSSLRSEDSAVYYCASSSGWYLFDYWGQGTLVTVSS

SEQ ID NO: 32109 - DNA, 354 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggattcaccttcaccaattatgatatcaactgggtgcgacaggccactggacaagggcttgagtggatgggatggatgcaccctaacagtggtaacacaggctttgcacagaagttccagggcagagtcacaatgaccaggaacacctccataagcacagcctacatggaactgagcagcctgagatctgaggacacggccgtgtattactgtgcggtttccagtggctggtactggttcgacccctggggccagggaaccctggtcaccgtctcctca

SEQ ID NO: 32110 - protein, 118 aa, Artificial Sequence; identical to SEQ ID NO: 29724
  Description of Artificial Sequence: Synthetic polypeptide

SEQ ID NO: 32111 - DNA, 354 bp, Artificial Sequence
  Description of Artificial Sequence: Synthetic polynucleotide
caggtgcagctggtgcagtctggggctgaagtgaagaagcctggggcctcagtgaaggtctcctgcaaggcttctggatacaccttcaccaattatgatatcaactgggtgcgacaggccactggacaagggcttgagtggatgggatggatgcaccctcacagtggtaacacaggctatgcacagaagttccagggcagagtcaccatgaccaggaacacctccataaacacagcctacatggagctgagcagcctgagatctgaggacacggccgtgtattactgtgcccatagcagtggctggtactactttgactactggggccagggaaccctggtcaccgtctcctca

SEQ ID NO: 32112 - protein, 118 aa, Artificial Sequence
  Description of Artificial Sequence: Synthetic polypeptide
QVQLVQSGAEVKKPGASVKVSCKASGYTFTNYDINWVRQATGQGLEWMGWMHPHSGNTGYAQKFQGRVTMTRNTSINTAYMELSSLRSEDTAVYYCAHSSGWYYFDYWGQGTLVTVSS

SEQ ID NO: 32113 - DNA, 354 bp, Artificial Sequence; identical to SEQ ID NO: 28125
  Description of Artificial Sequence: Synthetic polynucleotide

SEQ ID NO: 32114 - protein, 118 aa, Artificial Sequence; identical to SEQ ID NO: 28126
  Description of Artificial Sequence: Synthetic polypeptide

SEQ ID NO: 32115 - DNA, 387 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggctgaaccctcacagtggtaacacaggctatgcacagaagttccagggcagaatcaccatgacctggaacacctccatacgcactgcctacatggagctgagcagcctgagatctgaggacacggccgtgtattactgtgcgagagggttttacgatattttgactggttattcccccacctactactactacgatatggacgtctggggccaagggaccacggtcaccgtctcctca

SEQ ID NO: 32116 - protein, 129 aa, Artificial Sequence
  Description of Artificial Sequence: Synthetic polypeptide
QVQLVQSGAEVKKPGASVKVSCKASGYTFTSYDINWVRQATGQGLEWMGWLNPHSGNTGYAQKFQGRITMTWNTSIRTAYMELSSLRSEDTAVYYCARGFYDILTGYSPTYYYYDMDVWGQGTTVTVSS

SEQ ID NO: 32117 - DNA, 387 bp, Artificial Sequence; identical to SEQ ID NO: 32115
  Description of Artificial Sequence: Synthetic polynucleotide

SEQ ID NO: 32118 - protein, 129 aa, Artificial Sequence; identical to SEQ ID NO: 32116
  Description of Artificial Sequence: Synthetic polypeptide

SEQ ID NO: 32119 - DNA, 372 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggagggggctggagtgggtctcagctattagtggtagtggtggtaacacattctacgcagactccgtgaagggccggttcaccatctccagagacaattccaagaacacgctgtatctgcaaatgaacagcctgagagccgaggacacggccgtatattactgtgcgatccacggtatagcagtggctggtactggggctcactactttgactactggggccagggaaccctggccaccgtctcctca

SEQ ID NO: 32120 - protein, 124 aa, Artificial Sequence
  Description of Artificial Sequence: Synthetic polypeptide
EVQLLESGGGLVQPGGSLRLSCAASGFTFSSYAMSWVRQAPGRGLEWVSAISGSGGNTFYADSVKGRFTISRDNSKNTLYLQMNSLRAEDTAVYYCAIHGIAVAGTGAHYFDYWGQGTLATVSS

SEQ ID NO: 32121 - DNA, 387 bp, Artificial Sequence; identical to SEQ ID NO: 32115
  Description of Artificial Sequence: Synthetic polynucleotide

SEQ ID NO: 32122 - protein, 129 aa, Artificial Sequence; identical to SEQ ID NO: 32116
  Description of Artificial Sequence: Synthetic polypeptide

SEQ ID NO: 32123 - DNA, 387 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgacctggaacacctccatacgcactgcctacatggagctgagcagcctgagatctgaggacacggccgtgtattactgtgcgagagggttttacgatattttgactggttattcccccacctactactactacgatatggacgtctggggccaagggaccacggtcaccgtctcctca

SEQ ID NO: 32124 - protein, 129 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTWNTSIRTAYMELSSLRSEDTAVYYCARGFYDILTGYSPTYYYYDMDVWGQGTTVTVSS

SEQ ID NO: 32125 - DNA, 372 bp, Artificial Sequence
  Description of Artificial Sequence: Synthetic polynucleotide
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtaacacattctacgcagactccgtgaagggccggttcaccatctccagagacaattccaagaacacgctgtatctgcaaatgaacagcctgagagccgaggacacggccgtatattactgtgcgatccacggtatagcagtggctggtactggggctcactactttgactactggggccagggaaccctggccaccgtctcctca

SEQ ID NO: 32126 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGNTFYADSVKGRFTISRDNSKNTLYLQMNSLRAEDTAVYYCAIHGIAVAGTGAHYFDYWGQGTLATVSS

SEQ ID NO: 32127 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK

SEQ ID NO: 32128 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPITFGQGTRLEIK

SEQ ID NO: 32129 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK

SEQ ID NO: 32130 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 32131 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 32132 - protein, 107 aa, Artificial Sequence [sequence omitted]

SEQ ID NO: 32133 - protein, 112 aa, Artificial Sequence
  Description of Artificial Sequence: Synthetic polypeptide
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLPLTFGGGTKVEIK

SEQ ID NO: 32134 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSRFSGSGSGTDFTLTISSLQPEDFATYYCQQYNSYPFTFGPGTKVDIK

SEQ ID NO: 32135 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 32136 - protein, 107 aa, Artificial Sequence; identical to SEQ ID NO: 24146
  Description of Artificial Sequence: Synthetic polypeptide

SEQ ID NO: 32137 - protein, 112 aa, Artificial Sequence
  Description of Artificial Sequence: Synthetic polypeptide
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLPITFGQGTRLEIK

SEQ ID NO: 32138 - protein, 112 aa, Artificial Sequence
  Description of Artificial Sequence: Synthetic polypeptide
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLPWTFGQGTKVEIK

SEQ ID NO: 32139 - protein, 107 aa, Artificial Sequence; identical to SEQ ID NO: 24244
  Description of Artificial Sequence: Synthetic polypeptide

SEQ ID NO: 32140 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPYTFGQGTKLEIK

SEQ ID NO: 32141 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK

SEQ ID NO: 32142 - protein, 107 aa, Artificial Sequence; identical to SEQ ID NO: 24296
  Description of Artificial Sequence: Synthetic polypeptide

SEQ ID NO: 32143 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKVEIK

SEQ ID NO: 32144 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 32145 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPLTFGGGTKVEIK

SEQ ID NO: 32146 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPFTFGPGTKVDIK

SEQ ID NO: 32147 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPITFGQGTRLEIK

SEQ ID NO: 32148 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPWTFGQGTKVEIK

SEQ ID NO: 32149 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVDIK

SEQ ID NO: 32150 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 32151 - protein, 112 aa, Artificial Sequence
  Description of Artificial Sequence: Synthetic polypeptide
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLPFTFGPGTKVDIK

SEQ ID NO: 32152 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPFTFGPGTKVDIK

SEQ ID NO: 32153 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 32154 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSRFSGSGSGTDFTLTISSLQPEDFATYYCQQYNSYPWTFGQGTKVEIK

SEQ ID NO: 32155 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 32156 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 32157 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSRFSGSGSGTDFTLTISSLQPEDFATYYCQQYNSYPLTFGGGTKVEIK

SEQ ID NO: 32158 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 32159 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPFTFGPGTKVDIK

SEQ ID NO: 32160 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 32161 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 32162 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 32163 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 32164 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPWTFGQGTKVEIK

SEQ ID NO: 32165 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIK

SEQ ID NO: 32166 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 32167 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 32168 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 32169 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPWTFGQGTKVEIK

SEQ ID NO: 32170 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSRFSGSGSGTDFTLTISSLQPEDFATYYCQQYNSYPITFGQGTRLEIK

SEQ ID NO: 32171 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIK

SEQ ID NO: 32172 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIK

SEQ ID NO: 32173 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPWTFGQGTKVEIK

SEQ ID NO: 32174 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPLTFGGGTKVEIK

SEQ ID NO: 32175 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVDIK

SEQ ID NO: 32176 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPFTFGPGTKVDIK

SEQ ID NO: 32177 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPYTFGQGTKLEIK

SEQ ID NO: 32178 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 32179 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPWTFGQGTKVEIK

SEQ ID NO: 32180 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPITFGQGTRLEIK

SEQ ID NO: 32181 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSRFSGSGSGTDFTLTISSLQPEDFATYYCQQYNSYPYTFGQGTKLEIK

SEQ ID NO: 32182 - protein, 107 aa, Artificial Sequence; identical to SEQ ID NO: 24296
  Description of Artificial Sequence: Synthetic polypeptide

SEQ ID NO: 32183 - protein, 107 aa, Artificial Sequence; identical to SEQ ID NO: 32148
  Description of Artificial Sequence: Synthetic polypeptide

SEQ ID NO: 32184 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVL

SEQ ID NO: 32185 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLWVFGGGTKLTVL

SEQ ID NO: 32186 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL

SEQ ID NO: 32187 - protein, 108 aa, Artificial Sequence
  Description of Artificial Sequence: Synthetic polypeptide
SYELTQPPSVSVSPGQTARITCSGDALPKKYAYWYQQKSGQAPVLVIYEDSKRPSGIPERFSGSSSGTMATLTISGAQVEDEADYYCYSTDSSGNHVVFGGGTKLTVL

SEQ ID NO: 32188 - protein, 110 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 32189 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSSTAYVFGTGTKVTVL

SEQ ID NO: 32190 - protein, 116 aa, Artificial Sequence
  Description of Artificial Sequence: Synthetic polypeptide
QAVLTQPASLSASPGASASLTCTLRSGINVGTYRIYWYQQKPGSPPQYLLRYKSDSDKQQGSGVPSRFSGSKDASANAGILLISGLQSEDEADYYCMIWHSSASWVFGGGTKLTVL

SEQ ID NO: 32191 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 32192 - protein, 110 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVL

SEQ ID NO: 32193 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 32194 - protein, 111 aa, Artificial Sequence
  Description of Artificial Sequence: Synthetic polypeptide
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTFVVFGGGTKLTVL

SEQ ID NO: 32195 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHWVFGGGTKLTVL

SEQ ID NO: 32196 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL

SEQ ID NO: 32197 - protein, 107 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPERFSGSNSGNTATLTISGTQAMDEADYYCQAWDSSTAAVFGGGTQLTVL

SEQ ID NO: 32198 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 32199 - protein, 110 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNVVFGGGTKLTVL

SEQ ID NO: 32200 - protein, 110 aa, Artificial Sequence
  Description of Artificial Sequence: Synthetic polypeptide
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGIWVFGGGTKLTVL

SEQ ID NO: 32201 - protein, 110 aa, Artificial Sequence
  Description of Artificial Sequence: Synthetic polypeptide
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQVVFGGGTKLTVL

SEQ ID NO: 32202 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAWVFGGGTKLTVL

SEQ ID NO: 32203 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVL

SEQ ID NO: 32204 - protein, 116 aa, Artificial Sequence
  Description of Artificial Sequence: Synthetic polypeptide
QAVLTQPASLSASPGASASLTCTLRSGINVGTYRIYWYQQKPGSPPQYLLRYKSDSDKQQGSGVPSRFSGSKDASANAGILLISGLQSEDEADYYCMIWHSSASVVFGGGTKLTVL

SEQ ID NO: 32205 - protein, 107 aa, Artificial Sequence
  Description of Artificial Sequence: Synthetic polypeptide
SYELTQPLSVSVALGQTARITCGGNNIGSKNVHWYQQKPGQAPVLVIYRDSNRPSGIPERFSGSNSGNTATLTISRAQAGDEADYYCQVWDSSTAVVFGGGTKLTVL

SEQ ID NO: 32206 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVVFGGGTKLTVL

SEQ ID NO: 32207 - protein, 108 aa, Artificial Sequence
  Description of Artificial Sequence: Synthetic polypeptide
SYELMQPPSVSVSPGQTARITCSGDALPKQYAYWYQQKPGQAPVLVIYKDSERPSGIPERFSGSSSGTTVTLTISGVQAEDEADYYCQSADSSGTYYVFGTGTKVTVL

SEQ ID NO: 32208 - protein, 115 aa, Artificial Sequence
  Description of Artificial Sequence: Synthetic polypeptide
LPVLTQPPSASALLGASIKLTCTLSSEHSTYTIEWYQQRPGRSPQYIMKVKSDGSHSKGDGIPDRFMGSSSGADRYLTFSNLQSDDEAEYHCGESHTIDGQVGVVFGGGTKLTVL

SEQ ID NO: 32209 - protein, 108 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVL

SEQ ID NO: 32210 - protein, 120 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYSSGWYYFDYWGQGTLVTVSS

SEQ ID NO: 32211 - protein, 118 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGTTGTYFDYWGQGTLVTVSS

SEQ ID NO: 32212 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREYSSSSYYYYYGMDVWGQGTTVTVSS

SEQ ID NO: 32213 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDIVLMVYAIYFDYWGQGTLVTVSS

SEQ ID NO: 32214 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREYSSSSYFDYWGQGTLVTVSS

SEQ ID NO: 32215 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGIAVAGYYYYYGMDVWGQGTTVTVSS

SEQ ID NO: 32216 - protein, 121 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYSSGWYNWFDPWGQGTLVTVSS

SEQ ID NO: 32217 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGYSYGYYFDYWGQGTLVTVSS

SEQ ID NO: 32218 - protein, 120 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGIAVAGNWFDPWGQGTLVTVSS

SEQ ID NO: 32219 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYGGNSYYYYYGMDVWGQGTTVTVSS

SEQ ID NO: 32220 - protein, 118 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYSNYYFDYWGQGTLVTVSS

SEQ ID NO: 32221 - protein, 115 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARLTGYFDYWGQGTLVTVSS

SEQ ID NO: 32222 - protein, 122 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDYGDYYYYYYGMDVWGQGTTVTVSS

SEQ ID NO: 32223 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYGDYYYYYYGMDVWGQGTTVTVSS

SEQ ID NO: 32224 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYGDYYFDYWGQGTLVTVSS

SEQ ID NO: 32225 - protein, 116 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARLTGYFDYWGQGTLVTVSS

SEQ ID NO: 32226 - protein, 124 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARRDGYNYYYYYYGMDVWGQGTTVTVSS

SEQ ID NO: 32227 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDIVLMVYAINWFDPWGQGTLVTVSS

SEQ ID NO: 32228 - protein, 119 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYSYGYYFDYWGQGTLVTVSS

SEQ ID NO: 32229 - protein, 123 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTTGTYYYYYGMDVWGQGTTVTVSS

SEQ ID NO: 32230 - protein, 125 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARRDGYNYYYYYYGMDVWGQGTTVTVSS

SEQ ID NO: 32231 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARSIAARYFDYWGQGTLVTVSS

SEQ ID NO: 32232 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVQLERNWFDPWGQGTLVTVSS

SEQ ID NO: 32233 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVQLERYFDYWGQGTLVTVSS

SEQ ID NO: 32234 - protein, 120 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDYSNYNWFDPWGQGTLVTVSS

SEQ ID NO: 32235 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREYSSSSYYYYYGMDVWGQGTTVTVSS

SEQ ID NO: 32236 - protein, 119 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSIAARYFDYWGQGTLVTVSS

SEQ ID NO: 32237 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGIAVAGYYYYYGMDVWGQGTTVTVSS

SEQ ID NO: 32238 - protein, 119 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARVQLERYFDYWGQGTLVTVSS

SEQ ID NO: 32239 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARYYYDSSGYYYNWFDPWGQGTLVTVSS

SEQ ID NO: 32240 - protein, 123 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARYYYDSSGYYYYFDYWGQGTLVTVSS

SEQ ID NO: 32241 - protein, 98 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAR

SEQ ID NO: 32242 - protein, 17 aa, Artificial Sequence
  Description of Artificial Sequence: Synthetic peptide
LGYFDYWGQGTLVTVSS

SEQ ID NO: 32243 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDYSNYYFDYWGQGTLVTVSS

SEQ ID NO: 32244 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYSSSSYFDYWGQGTLVTVSS

SEQ ID NO: 32245 - protein, 116 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLTGYFDYWGQGTLVTVSS

SEQ ID NO: 32246 - protein, 118 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDYSNYYFDYWGQGTLVTVSS

SEQ ID NO: 32247 - protein, 117 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKLTGDAFDIWGQGTMVTVSS

SEQ ID NO: 32248 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGIAAAGYFDYWGQGTLVTVSS

SEQ ID NO: 32249 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYGDYYYYYYGMDVWGQGTTVTVSS

SEQ ID NO: 32250 - protein, 124 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARRDGYNYYYYYYGMDVWGQGTTVTVSS

SEQ ID NO: 32251 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGIAAAGYFDYWGQGTLVTVSS

SEQ ID NO: 32252 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIAVAGDAFDIWGQGTMVTVSS

SEQ ID NO: 32253 - protein, 119 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARSIAARDAFDIWGQGTMVTVSS

SEQ ID NO: 32254 - protein, 118 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARSIAARYFDYWGQGTLVTVSS

SEQ ID NO: 32255 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIAAAGYFDYWGQGTLVTVSS

SEQ ID NO: 32256 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIAVAGNWFDPWGQGTLVTVSS

SEQ ID NO: 32257 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVQLERYFDYWGQGTLVTVSS

SEQ ID NO: 32258 - protein, 128 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYCSGGSCYSYYYYYGMDVWGQGTTVTVSS

SEQ ID NO: 32259 - protein, 127 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDIVVVVAATYYYYYGMDVWGQGTTVTVSS

SEQ ID NO: 32260 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGITGTDAFDIWGQGTMVTVSS

SEQ ID NO: 32261 - protein, 116 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKLTGYFDYWGQGTLVTVSS

SEQ ID NO: 32262 - protein, 98 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAR

SEQ ID NO: 32263 - protein, 20 aa, Artificial Sequence
  Description of Artificial Sequence: Synthetic peptide
RWLQLYFDYWGQGTLVTVSS

SEQ ID NO: 32264 - protein, 116 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNWGYFDYWGQGTLVTVSS

SEQ ID NO: 32265 - protein, 123 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSIAARYYYYYGMDVWGQGTTVTVSS

SEQ ID NO: 32266 - protein, 102 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRILY

SEQ ID NO: 32267 - protein, 20 aa, Artificial Sequence
  Description of Artificial Sequence: Synthetic peptide
WCMLYYFDYWGQGTLVTVSS

SEQ ID NO: 32268 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKTTVVTYFDYWGQGTLVTVSS

SEQ ID NO: 32269 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIVGATDAFDIWGQGTMVTVSS

SEQ ID NO: 32270 - protein, 98 aa, Artificial Sequence; identical to SEQ ID NO: 32241
  Description of Artificial Sequence: Synthetic polypeptide

SEQ ID NO: 32271 - protein, 20 aa, Artificial Sequence
  Description of Artificial Sequence: Synthetic peptide
RWLQLYFDYWGQGTLVTVSS

SEQ ID NO: 32272 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYGDYYFDYWGQGTLVTVSS

SEQ ID NO: 32273 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGTTGTYFDYWGQGTLVTVSS

SEQ ID NO: 32274 - protein, 116 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARNWGYFDYWGQGTLVTVSS

SEQ ID NO: 32275 - protein, 99 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARV

SEQ ID NO: 32276 - protein, 18 aa, Artificial Sequence
  Description of Artificial Sequence: Synthetic peptide
QLVYFDYWGQGTLVTVSS

SEQ ID NO: 32277 - protein, 123 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDYGDYYYYYYGMDVWGQGTTVTVSS

SEQ ID NO: 32278 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDYGDYDAFDIWGQGTMVTVSS

SEQ ID NO: 32279 - protein, 120 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGTTGTYWYFDLWGRGTLVTVSS

SEQ ID NO: 32280 - protein, 119 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARVEMATIYFDYWGQGTLVTVSS

SEQ ID NO: 32281 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVQLERYFDYWGQGTLVTVSS

SEQ ID NO: 32282 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYSYGYYYYYYGMDVWGQGTTVTVSS

SEQ ID NO: 32283 - protein, 121 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARGYSGYDYYFDYWGQGTLVTVSS

SEQ ID NO: 32284 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKITMIVVVITYFDYWGQGTLVTVSS

SEQ ID NO: 32285 - protein, 116 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARTTVTYFDYWGQGTLVTVSS

SEQ ID NO: 32286 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSYGYDAFDIWGQGTMVTVSS

SEQ ID NO: 32287 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVDTAMVYFDYWGQGTLVTVSS

SEQ ID NO: 32288 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYNWNDYFDYWGQGTLVTVSS

SEQ ID NO: 32289 - protein, 121 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGYSGYDYYFDYWGQGTLVTVSS

SEQ ID NO: 32290 - protein, 116 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARLTGYFDYWGQGTLVTVSS

SEQ ID NO: 32291 - protein, 117 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKTTVTYFDYWGQGTLVTVSS

SEQ ID NO: 32292 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYNWNDYFDYWGQGTLVTVSS

SEQ ID NO: 32293 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKITIFGVVIIYFDYWGQGTLVTVSS

SEQ ID NO: 32294 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKITMIVVVITAEYFQHWGQGTLVTVSS

SEQ ID NO: 32295 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDIVVVVAATYFDYWGQGTLVTVSS

SEQ ID NO: 32296 - protein, 118 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGDYYFDYWGQGTLVTVSS

SEQ ID NO: 32297 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARITMIVVVITYYYYYGMDVWGQGTTVTVSS

SEQ ID NO: 32298 - protein, 120 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARYSGSYYYFDYWGQGTLVTVSS

SEQ ID NO: 32299 - protein, 116 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARNWGYFDYWGQGTLVTVSS

SEQ ID NO: 32300 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYSGSYYYFDYWGQGTLVTVSS

SEQ ID NO: 32301 - protein, 119 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGIAVAGYFDYWGQGTLVTVSS

SEQ ID NO: 32302 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYSNYYFDYWGQGTLVTVSS

SEQ ID NO: 32303 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDYSNYYFDYWGQGTLVTVSS

SEQ ID NO: 32304 - protein, 98 aa, Artificial Sequence; identical to SEQ ID NO: 32241
  Description of Artificial Sequence: Synthetic polypeptide

SEQ ID NO: 32305 - protein, 19 aa, Artificial Sequence
  Description of Artificial Sequence: Synthetic peptide
LGAEYFQHWGQGTLVTVSS

SEQ ID NO: 32306 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYYYDSSGYYYDAFDIWGQGTMVTVSS

SEQ ID NO: 32307 - protein, 117 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARTTVTYFDYWGQGTLVTVSS

SEQ ID NO: 32308 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARTTVTDAFDIWGQGTMVTVSS

SEQ ID NO: 32309 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARSIAARYFDYWGQGTLVTVSS

SEQ ID NO: 32310 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARYSGSYYYFDYWGQGTLVTVSS

SEQ ID NO: 32311 - protein, 122 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDIVVVVAATYFDYWGQGTLVTVSS

SEQ ID NO: 32312 - protein, 107 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVLLWFGELL

SEQ ID NO: 32313 - protein, 15 aa, Artificial Sequence
  Description of Artificial Sequence: Synthetic peptide
YFDYWGQGTLVTVSS

SEQ ID NO: 32314 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSSSWYYFDYWGQGTLVTVSS

SEQ ID NO: 32315 - protein, 117 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDYGDYYFDYWGQGTLVTVSS

SEQ ID NO: 32316 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDIVVVVAATAEYFQHWGQGTLVTVSS

SEQ ID NO: 32317 - protein, 118 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLTGNWFDPWGQGTLVTVSS

SEQ ID NO: 32318 - protein, 120 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTVQLERYFDYWGQGTLVTVSS

SEQ ID NO: 32319 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGYSYGYYFDYWGQGTLVTVSS

SEQ ID NO: 32320 - protein, 127 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYYGSGSYYNYYYYYGMDVWGQGTTVTVSS

SEQ ID NO: 32321 - protein, 106 aa, Artificial Sequence
  Description of Artificial Sequence: Synthetic polypeptide
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARVLRYFDWLL

SEQ ID NO: 32322 - protein, 20 aa, Artificial Sequence
  Description of Artificial Sequence: Synthetic peptide
YYYYYGMDVWGQGTTVTVSS

SEQ ID NO: 32323 - protein, 119 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARYSGSYYYFDYWGQGTLVTVSS

SEQ ID NO: 32324 - protein, 123 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGTTGTYYYYYGMDVWGQGTTVTVSS

SEQ ID NO: 32325 - protein, 128 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARYYYDSSGYYYYYYYYGMDVWGQGTTVTVSS

SEQ ID NO: 32326 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDIVVVVAATDAFDIWGQGTMVTVSS

SEQ ID NO: 32327 - protein, 117 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLTGYFDYWGQGTLVTVSS

SEQ ID NO: 32328 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYGDYNWFDPWGQGTLVTVSS

SEQ ID NO: 32329 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKITMIVVVITYYYYYGMDVWGQGTTVTVSS

SEQ ID NO: 32330 - protein, 120 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGTTGTDAFDIWGQGTMVTVSS

SEQ ID NO: 32331 - protein, 120 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGYSSSWYYFDYWGQGTLVTVSS

SEQ ID NO: 32332 - protein, 125 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARGYSYGYYYYYYGMDVWGQGTTVTVSS

SEQ ID NO: 32333 - protein, 121 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARRDGYNYDAFDIWGQGTMVTVSS

SEQ ID NO: 32334 - protein, 118 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDYSNYYFDYWGQGTLVTVSS

SEQ ID NO: 32335 - protein, 122 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDIVVVVAATYFDYWGQGTLVTVSS

SEQ ID NO: 32336 - protein, 126 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGYSGYDYYYYYYGMDVWGQGTTVTVSS

SEQ ID NO: 32337 - protein, 118 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARSIAARYFDYWGQGTLVTVSS

SEQ ID NO: 32338 - protein, 120 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARWIQLWLNWFDPWGQGTLVTVSS

SEQ ID NO: 32339 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYYYDSSGYYYYFDYWGQGTLVTVSS

SEQ ID NO: 32340 - protein, 99 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKV

SEQ ID NO: 32341 - protein, 19 aa, Artificial Sequence
  Description of Artificial Sequence: Synthetic peptide
WELLYFDYWGQGTLVTVSS

SEQ ID NO: 32342 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSYGYYFDYWGQGTLVTVSS

SEQ ID NO: 32343 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSSGWYDAFDIWGQGTMVTVSS

SEQ ID NO: 32344 - protein, 122 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHIVVVTAIYFDYWGQGTLVTVSS

SEQ ID NO: 32345 - protein, 128 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYYYGSGSYYNYYYYYGMDVWGQGTTVTVSS

SEQ ID NO: 32346 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGTTGTYYYYYGMDVWGQGTTVTVSS

SEQ ID NO: 32347 - protein, 123 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGTTGTYYYYYGMDVWGQGTTVTVSS

SEQ ID NO: 32348 - protein, 118 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGTTGTYFDYWGQGTLVTVSS

SEQ ID NO: 32349 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYSGSYYYYYYYGMDVWGQGTTVTVSS

SEQ ID NO: 32350 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKHIVVVTAIYFDYWGQGTLVTVSS

SEQ ID NO: 32351 - protein, 120 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARYNWNDNWFDPWGQGTLVTVSS

SEQ ID NO: 32352 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVQLERYYYYYGMDVWGQGTTVTVSS

SEQ ID NO: 32353 - protein, 115 aa, Artificial Sequence
  Description of Artificial Sequence: Synthetic polypeptide
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARNWGYFDYWGQGTLVTVSS

SEQ ID NO: 32354 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREYSSSSYYYYYGMDVWGQGTTVTVSS

SEQ ID NO: 32355 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGIAAAGYYYYYGMDVWGQGTTVTVSS

SEQ ID NO: 32356 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVDTAMVYYYYYGMDVWGQGTTVTVSS

SEQ ID NO: 32357 - protein, 121 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLTGYYYYYGMDVWGQGTTVTVSS

SEQ ID NO: 32358 - protein, 98 aa, Artificial Sequence; identical to SEQ ID NO: 32262
  Description of Artificial Sequence: Synthetic polypeptide

SEQ ID NO: 32359 - protein, 25 aa, Artificial Sequence
  Description of Artificial Sequence: Synthetic peptide
RWLQLYYYYYGMDVWGQGTTVTVSS

SEQ ID NO: 32360 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYYDILTGYYNYFDYWGQGTLVTVSS

SEQ ID NO: 32361 - protein, 127 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDIVVVVAATYYYYYGMDVWGQGTTVTVSS

SEQ ID NO: 32362 - protein, 106 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARVLRYFDWLL

SEQ ID NO: 32363 - protein, 20 aa, Artificial Sequence
  Description of Artificial Sequence: Synthetic peptide
YYYYYGMDVWGQGTTVTVSS

SEQ ID NO: 32364 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYGGNSYFDYWGQGTLVTVSS

SEQ ID NO: 32365 - protein, 99 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARV

SEQ ID NO: 32366 - protein, 23 aa, Artificial Sequence
  Description of Artificial Sequence: Synthetic peptide
LELYYYYYGMDVWGQGTTVTVSS

SEQ ID NO: 32367 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRDGYNYDAFDIWGQGTMVTVSS

SEQ ID NO: 32368 - protein, 119 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGTTGTDAFDIWGQGTMVTVSS

SEQ ID NO: 32369 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYYYDSSGYYYYFDYWGQGTLVTVSS

SEQ ID NO: 32370 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYYYDSSGYYYAEYFQHWGQGTLVTVSS

SEQ ID NO: 32371 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRDGYNYYFDYWGQGTLVTVSS

SEQ ID NO: 32372 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARTTVTYYYYYGMDVWGQGTTVTVSS

SEQ ID NO: 32373 - protein, 102 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRILY

SEQ ID NO: 32374 - protein, 21 aa, Artificial Sequence
  Description of Artificial Sequence: Synthetic peptide
WCMLYDAFDIWGQGTMVTVSS

SEQ ID NO: 32375 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARWIQLWLYYYYYGMDVWGQGTTVTVSS

SEQ ID NO: 32376 - protein, 121 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGYSSGWYNWFDPWGQGTLVTVSS

SEQ ID NO: 32377 - protein, 122 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARITMVRGVIIYFDYWGQGTLVTVSS

SEQ ID NO: 32378 - protein, 122 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDYGDYYYYYYGMDVWGQGTTVTVSS

SEQ ID NO: 32379 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDYGDYYYYYYGMDVWGQGTTVTVSS

SEQ ID NO: 32380 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSGYDYNWFDPWGQGTLVTVSS

SEQ ID NO: 32381 - protein, 108 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARVLRYFDWLL

SEQ ID NO: 32382 - protein, 15 aa, Artificial Sequence
  Description of Artificial Sequence: Synthetic peptide
YFDYWGQGTLVTVSS

SEQ ID NO: 32383 - protein, 122 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARRDGYNYYWYFDLWGRGTLVTVSS

SEQ ID NO: 32384 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYSNYYYYYYGMDVWGQGTTVTVSS

SEQ ID NO: 32385 - protein, 106 aa, Artificial Sequence; identical to SEQ ID NO: 32362
  Description of Artificial Sequence: Synthetic polypeptide

SEQ ID NO: 32386 - protein, 15 aa, Artificial Sequence
  Description of Artificial Sequence: Synthetic peptide
YFDYWGQGTLVTVSS

SEQ ID NO: 32387 - protein, 129 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARYYYDSSGYYYYYYYYGMDVWGQGTTVTVSS

SEQ ID NO: 32388 - protein, 129 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARYYYDSSGYYYYYYYYGMDVWGQGTTVTVSS

SEQ ID NO: 32389 - protein, 121 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARRDGYNYNWFDPWGQGTLVTVSS

SEQ ID NO: 32390 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDIVVVVAATYYYYYGMDVWGQGTTVTVSS

SEQ ID NO: 32391 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARYNWNDNWFDPWGQGTLVTVSS

SEQ ID NO: 32392 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGTTGTDAFDIWGQGTMVTVSS

SEQ ID NO: 32393 - protein, 116 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARNWGYFDYWGQGTLVTVSS

SEQ ID NO: 32394 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIAVAGYFDYWGQGTLVTVSS

SEQ ID NO: 32395 - protein, 120 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARRDGYNYYFDYWGQGTLVTVSS

SEQ ID NO: 32396 - protein, 100 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVL

SEQ ID NO: 32397 - protein, 25 aa, Artificial Sequence
  Description of Artificial Sequence: Synthetic peptide
LRLGELSLYDAFDIWGQGTMVTVSS

SEQ ID NO: 32398 - protein, 98 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 32399 - protein, 17 aa, Artificial Sequence
  Description of Artificial Sequence: Synthetic peptide
LGYFDYWGQGTLVTVSS

SEQ ID NO: 32400 - protein, 124 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGTTGTYYYYYGMDVWGQGTTVTVSS

SEQ ID NO: 32401 - protein, 117 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDYSNYYFDYWGQGTLVTVSS

SEQ ID NO: 32402 - protein, 118 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTTGTYFDYWGQGTLVTVSS

SEQ ID NO: 32403 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARNWGYYYYYGMDVWGQGTTVTVSS

SEQ ID NO: 32404 - protein, 121 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYSYGYAEYFQHWGQGTLVTVSS

SEQ ID NO: 32405 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARYSGSYYYYYYYGMDVWGQGTTVTVSS

SEQ ID NO: 32406 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDYGDYDAFDIWGQGTMVTVSS

SEQ ID NO: 32407 - protein, 98 aa, Artificial Sequence; identical to SEQ ID NO: 32241
  Description of Artificial Sequence: Synthetic polypeptide

SEQ ID NO: 32408 - protein, 25 aa, Artificial Sequence
  Description of Artificial Sequence: Synthetic peptide
RWLQLYYYYYGMDVWGQGTTVTVSS

SEQ ID NO: 32409 - protein, 99 aa, Artificial Sequence; identical to SEQ ID NO: 32275
  Description of Artificial Sequence: Synthetic polypeptide

SEQ ID NO: 32410 - protein, 24 aa, Artificial Sequence
  Description of Artificial Sequence: Synthetic peptide
QWLVYYYYYGMDVWGQGTTVTVSS

SEQ ID NO: 32411 - protein, 99 aa, Artificial Sequence; identical to SEQ ID NO: 32340
  Description of Artificial Sequence: Synthetic polypeptide

SEQ ID NO: 32412 - protein, 23 aa, Artificial Sequence
  Description of Artificial Sequence: Synthetic peptide
QLVYYYYYGMDVWGQGTTVTVSS

SEQ ID NO: 32413 - protein, 103 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARSILWW

SEQ ID NO: 32414 - protein, 19 aa, Artificial Sequence
  Description of Artificial Sequence: Synthetic peptide
LLFNWFDPWGQGTLVTVSS

SEQ ID NO: 32415 - protein, 127 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARITMVRGVIIYYYYYGMDVWGQGTTVTVSS

SEQ ID NO: 32416 - protein, 125 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGYSYGYYYYYYGMDVWGQGTTVTVSS

SEQ ID NO: 32417 - protein, 128 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARYYDFWSGYYTYYYYYGMDVWGQGTTVTVSS

SEQ ID NO: 32418 - protein, 110 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARVLRYFDWLL

SEQ ID NO: 32419 - protein, 20 aa, Artificial Sequence
  Description of Artificial Sequence: Synthetic peptide
YYYYYGMDVWGQGTTVTVSS

SEQ ID NO: 32420 - protein, 119 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGGNSYFDYWGQGTLVTVSS

SEQ ID NO: 32421 - protein, 120 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYSYGYNWFDPWGQGTLVTVSS

SEQ ID NO: 32422 - protein, 125 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYSSSWYYYYYYGMDVWGQGTTVTVSS

SEQ ID NO: 32423 - protein, 123 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDYGDYYYYYYGMDVWGQGTTVTVSS

SEQ ID NO: 32424 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGITGTYYYYYGMDVWGQGTTVTVSS

SEQ ID NO: 32425 - protein, 98 aa, Artificial Sequence; identical to SEQ ID NO: 32241
  Description of Artificial Sequence: Synthetic polypeptide

SEQ ID NO: 32426 - protein, 22 aa, Artificial Sequence
  Description of Artificial Sequence: Synthetic peptide
LGYYYYYGMDVWGQGTTVTVSS

SEQ ID NO: 32427 - protein, 98 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARV

SEQ ID NO: 32428 - protein, 20 aa, Artificial Sequence
  Description of Artificial Sequence: Synthetic peptide
QWLVDAFDIWGQGTMVTVSS

SEQ ID NO: 32429 - protein, 120 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDYGDYAEYFQHWGQGTLVTVSS

SEQ ID NO: 32430 - protein, 123 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGTTGTYYYYYGMDVWGQGTTVTVSS

SEQ ID NO: 32431 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGYSYGYYYYYYGMDVWGQGTTVTVSS

SEQ ID NO: 32432 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRDGYNYNWFDPWGQGTLVTVSS

SEQ ID NO: 32433 - protein, 123 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDYSNYYYYYYGMDVWGQGTTVTVSS

SEQ ID NO: 32434 - protein, 103 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARSILWW

SEQ ID NO: 32435 - protein, 18 aa, Artificial Sequence
  Description of Artificial Sequence: Synthetic peptide
LLFYFDYWGQGTLVTVSS

SEQ ID NO: 32436 - protein, 119 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREYSSSSYFDYWGQGTLVTVSS

SEQ ID NO: 32437 - protein, 98 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARV

SEQ ID NO: 32438 - protein, 24 aa, Artificial Sequence
  Description of Artificial Sequence: Synthetic peptide
QWLVYYYYYGMDVWGQGTTVTVSS

SEQ ID NO: 32439 - protein, 122 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDIVVVVAATYFDYWGQGTLVTVSS

SEQ ID NO: 32440 - protein, 125 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYYYDSSGYYYAEYFQHWGQGTLVTVSS

SEQ ID NO: 32441 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGGNSYYYYYGMDVWGQGTTVTVSS

SEQ ID NO: 32442 - protein, 99 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAR

SEQ ID NO: 32443 - protein, 2 aa, Artificial Sequence
  Description of Artificial Sequence: Synthetic peptide
LR

SEQ ID NO: 32444 - protein, 16 aa, Artificial Sequence
  Description of Artificial Sequence: Synthetic peptide
LYFDYWGQGTLVTVSS

SEQ ID NO: 32445 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYSNYNWFDPWGQGTLVTVSS

SEQ ID NO: 32446 - protein, 123 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARSIAARYYYYYGMDVWGQGTTVTVSS

SEQ ID NO: 32447 - protein, 124 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDYGDYYYYYYGMDVWGQGTTVTVSS

SEQ ID NO: 32448 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDYGDYAEYFQHWGQGTLVTVSS

SEQ ID NO: 32449 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKLTGYYYYYGMDVWGQGTTVTVSS

SEQ ID NO: 32450 - protein, 123 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDYSNYYYYYYGMDVWGQGTTVTVSS

SEQ ID NO: 32451 - protein, 125 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARVDIVATIYYYYYGMDVWGQGTTVTVSS

SEQ ID NO: 32452 - protein, 128 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARYYDFWSGYYTYYYYYGMDVWGQGTTVTVSS

SEQ ID NO: 32453 - protein, 128 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYYDFWSGYYTYYYYYGMDVWGQGTTVTVSS

SEQ ID NO: 32454 - protein, 118 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARNWGNWFDPWGQGTLVTVSS

SEQ ID NO: 32455 - protein, 120 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGYSSSWYYFDYWGQGTLVTVSS

SEQ ID NO: 32456 - protein, 120 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGIAVAGNWFDPWGQGTLVTVSS

SEQ ID NO: 32457 - protein, 128 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARYYYDSSGYYYYYYYYGMDVWGQGTTVTVSS

SEQ ID NO: 32458 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGYSSGWYYFDYWGQGTLVTVSS

SEQ ID NO: 32459 - protein, 129 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGYCSSTSCYTYYYYYGMDVWGQGTTVTVSS

SEQ ID NO: 32460 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRDGYNYYYYYYGMDVWGQGTTVTVSS

SEQ ID NO: 32461 - protein, 124 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARVDTAMVYYYYYGMDVWGQGTTVTVSS

SEQ ID NO: 32462 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVEMATIYYYYYGMDVWGQGTTVTVSS

SEQ ID NO: 32463 - protein, 107 aa, Artificial Sequence; identical to SEQ ID NO: 32312
  Description of Artificial Sequence: Synthetic polypeptide

SEQ ID NO: 32464 - protein, 20 aa, Artificial Sequence
  Description of Artificial Sequence: Synthetic peptide
YYYYYGMDVWGQGTTVTVSS

SEQ ID NO: 32465 - protein, 116 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARNWGYFDYWGQGTLVTVSS

SEQ ID NO: 32466 - protein, 98 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAR

SEQ ID NO: 32467 - protein, 3 aa, Artificial Sequence
  Description of Artificial Sequence: Synthetic peptide
LRW

SEQ ID NO: 32468 - protein, 21 aa, Artificial Sequence
  Description of Artificial Sequence: Synthetic peptide
LYYYYYGMDVWGQGTTVTVSS

SEQ ID NO: 32469 - protein, 126 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARSIAARYYYYYGMDVWGQGTTVTVSS

SEQ ID NO: 32470 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYNWNDYYYYYGMDVWGQGTTVTVSS

SEQ ID NO: 32471 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGTTGTYFDYWGQGTLVTVSS

SEQ ID NO: 32472 - protein, 120 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSIAARDAFDIWGQGTMVTVSS

SEQ ID NO: 32473 - protein, 124 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYSYGYYYYYYGMDVWGQGTTVTVSS

SEQ ID NO: 32474 - protein, 124 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARRDGYNYYWYFDLWGRGTLVTVSS

SEQ ID NO: 32475 - protein, 120 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARRDGYNYNWFDPWGQGTLVTVSS

SEQ ID NO: 32476 - protein, 117 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHLTGYFDYWGQGTLVTVSS

SEQ ID NO: 32477 - protein, 121 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSIAARAEYFQHWGQGTLVTVSS

SEQ ID NO: 32478 - protein, 128 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARYYYGSGSYYNYYYYYGMDVWGQGTTVTVSS

SEQ ID NO: 32479 - protein, 125 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGYSGYDYYYYYYGMDVWGQGTTVTVSS

SEQ ID NO: 32480 - protein, 123 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDYGDYYYYYYGMDVWGQGTTVTVSS

SEQ ID NO: 32481 - protein, 130 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYYDYVWGSYRYTYYYYYGMDVWGQGTTVTVSS

SEQ ID NO: 32482 - protein, 120 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHGTTGTDAFDIWGQGTMVTVSS

SEQ ID NO: 32483 - protein, 119 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDYSNYDAFDIWGQGTMVTVSS

SEQ ID NO: 32484 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARYYYDSSGYYYDAFDIWGQGTMVTVSS

SEQ ID NO: 32485 - protein, 126 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDYGDYYYYYYGMDVWGQGTTVTVSS

SEQ ID NO: 32486 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARLTGDAFDIWGQGTMVTVSS

SEQ ID NO: 32487 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDIVVVVAATYFDYWGQGTLVTVSS

SEQ ID NO: 32488 - protein, 125 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYSGYDYYYYYYGMDVWGQGTTVTVSS

SEQ ID NO: 32489 - protein, 100 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHV

SEQ ID NO: 32490 - protein, 18 aa, Artificial Sequence
  Description of Artificial Sequence: Synthetic peptide
QLVYFDYWGQGTLVTVSS

SEQ ID NO: 32491 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDIVLMVYAIYFDYWGQGTLVTVSS

SEQ ID NO: 32492 - protein, 121 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDYGDYYFDYWGQGTLVTVSS

SEQ ID NO: 32493 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYNWNYYYYYYGMDVWGQGTTVTVSS

SEQ ID NO: 32494 - protein, 124 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDYSNYYYYYYGMDVWGQGTTVTVSS

SEQ ID NO: 32495 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGIVGATYFDYWGQGTLVTVSS

SEQ ID NO: 32496 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKEYSSSSYFDYWGQGTLVTVSS

SEQ ID NO: 32497 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGIVGATYYYYYGMDVWGQGTTVTVSS

SEQ ID NO: 32498 - protein, 124 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARYYYGSGSYYNNWFDPWGQGTLVTVSS

SEQ ID NO: 32499 - protein, 128 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARDIVLMVYAIYYYYYGMDVWGQGTTVTVSS

SEQ ID NO: 32500 - protein, 115 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARNWGYFDYWGQGTLVTVSS

SEQ ID NO: 32501 - protein, 120 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDYGDYYFDYWGQGTLVTVSS

SEQ ID NO: 32502 - protein, 107 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVLRYFDWLL

SEQ ID NO: 32503 - protein, 15 aa, Artificial Sequence
  Description of Artificial Sequence: Synthetic peptide
YFDYWGQGTLVTVSS

SEQ ID NO: 32504 - protein, 117 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARNWGAEYFQHWGQGTLVTVSS

SEQ ID NO: 32505 - protein, 123 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREYSSSSYYYYYGMDVWGQGTTVTVSS

SEQ ID NO: 32506 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKEYSSSSAEYFQHWGQGTLVTVSS

SEQ ID NO: 32507 - protein, 124 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARSIAARYYYYYGMDVWGQGTTVTVSS

SEQ ID NO: 32508 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYSGSYYDAFDIWGQGTMVTVSS

SEQ ID NO: 32509 - protein, 118 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDYGDYYFDYWGQGTLVTVSS

SEQ ID NO: 32510 - protein, 128 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDIVLMVYAIYYYYYGMDVWGQGTTVTVSS

SEQ ID NO: 32511 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDYGDYNWFDPWGQGTLVTVSS

SEQ ID NO: 32512 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGYSGYDYYYYYYGMDVWGQGTTVTVSS

SEQ ID NO: 32513 - protein, 125 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGIAVAGYYYYYGMDVWGQGTTVTVSS

SEQ ID NO: 32514 - protein, 98 aa, Artificial Sequence; identical to SEQ ID NO: 32466
  Description of Artificial Sequence: Synthetic polypeptide

SEQ ID NO: 32515 - protein, 17 aa, Artificial Sequence
  Description of Artificial Sequence: Synthetic peptide
LGYFDYWGQGTLVTVSS

SEQ ID NO: 32516 - protein, 126 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARAYCGGDCYSNWFDPWGQGTLVTVSS

SEQ ID NO: 32517 - protein, 123 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGDYYYYYYGMDVWGQGTTVTVSS

SEQ ID NO: 32518 - protein, 128 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGYCSSTSCYTYYYYYGMDVWGQGTTVTVSS

SEQ ID NO: 32519 - protein, 127 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKAYCGGDCYSYYYYYGMDVWGQGTTVTVSS

SEQ ID NO: 32520 - protein, 100 aa, Artificial Sequence; identical to SEQ ID NO: 32489
  Description of Artificial Sequence: Synthetic polypeptide

SEQ ID NO: 32521 - protein, 19 aa, Artificial Sequence
  Description of Artificial Sequence: Synthetic peptide
QQLVYFDYWGQGTLVTVSS

SEQ ID NO: 32522 - protein, 123 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDYSNYYYYYYGMDVWGQGTTVTVSS

SEQ ID NO: 32523 - protein, 120 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGYSYGYNWFDPWGQGTLVTVSS

SEQ ID NO: 32524 - protein, 119 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGIVGATYFDYWGQGTLVTVSS

SEQ ID NO: 32525 - protein, 127 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARAYCGGDCYSYYYYYGMDVWGQGTTVTVSS

SEQ ID NO: 32526 - protein, 119 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDYGDYYFDYWGQGTLVTVSS

SEQ ID NO: 32527 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARRDGYNYYYYYYGMDVWGQGTTVTVSS

SEQ ID NO: 32528 - protein, 108 aa, Artificial Sequence
  Description of Artificial Sequence: Synthetic polypeptide
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARVLRYFDWLL

SEQ ID NO: 32529 - protein, 15 aa, Artificial Sequence
  Description of Artificial Sequence: Synthetic peptide
YFDYWGQGTLVTVSS

SEQ ID NO: 32530 - protein, 118 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHTTVTYFDYWGQGTLVTVSS

SEQ ID NO: 32531 - protein, 128 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYCSSTSCYTYYYYYGMDVWGQGTTVTVSS

SEQ ID NO: 32532 - protein, 125 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSGYDYYYYYYGMDVWGQGTTVTVSS

SEQ ID NO: 32533 - protein, 119 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDYGDYYFDYWGQGTLVTVSS

SEQ ID NO: 32534 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDYSNYDAFDIWGQGTMVTVSS

SEQ ID NO: 32535 - protein, 128 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYSSGWYYYYYYGMDVWGQGTTVTVSS

SEQ ID NO: 32536 - protein, 131 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYCSGGSCYSYYYYYGMDVWGQGTTVTVSS

SEQ ID NO: 32537 - protein, 120 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARYNWNDYWYFDLWGRGTLVTVSS

SEQ ID NO: 32538 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARYSGSYYYFDYWGQGTLVTVSS

SEQ ID NO: 32539 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIAAAGYWYFDLWGRGTLVTVSS

SEQ ID NO: 32540 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARRDGYNYYFDYWGQGTLVTVSS

SEQ ID NO: 32541 - protein, 116 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARLTGYFDYWGQGTLVTVSS

SEQ ID NO: 32542 - protein, 118 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDYSNYYFDYWGQGTLVTVSS

SEQ ID NO: 32543 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGTTGTYFDYWGQGTLVTVSS

SEQ ID NO: 32544 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYSSSSDAFDIWGQGTMVTVSS

SEQ ID NO: 32545 - protein, 117 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARNWGNWFDPWGQGTLVTVSS

SEQ ID NO: 32546 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGTTGTNWFDPWGQGTLVTVSS

SEQ ID NO: 32547 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIAVAGAEYFQHWGQGTLVTVSS

SEQ ID NO: 32548 - protein, 122 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARYSGSYYAEYFQHWGQGTLVTVSS

SEQ ID NO: 32549 - protein, 122 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAYCGGDCYSYFDYWGQGTLVTVSS

SEQ ID NO: 32550 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGIAVAGYYYYYGMDVWGQGTTVTVSS

SEQ ID NO: 32551 - protein, 98 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAR

SEQ ID NO: 32552 - protein, 17 aa, Artificial Sequence
  Description of Artificial Sequence: Synthetic peptide
LGYFDYWGQGTLVTVSS

SEQ ID NO: 32553 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGTTGTNWFDPWGQGTLVTVSS

SEQ ID NO: 32554 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSIAARYFDYWGQGTLVTVSS

SEQ ID NO: 32555 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSIAARNWFDPWGQGTLVTVSS

SEQ ID NO: 32556 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVQLERYWYFDLWGRGTLVTVSS

SEQ ID NO: 32557 - protein, 125 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARVDTAMVYYYYYGMDVWGQGTTVTVSS

SEQ ID NO: 32558 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYCSSTSCYTDAFDIWGQGTMVTVSS

SEQ ID NO: 32559 - protein, 120 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTYNWNDYFDYWGQGTLVTVSS

SEQ ID NO: 32560 - protein, 117 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARTTVTYFDYWGQGTLVTVSS

SEQ ID NO: 32561 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYSGSYYYFDYWGQGTLVTVSS

SEQ ID NO: 32562 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKITIFGVVIIDAFDIWGQGTMVTVSS

SEQ ID NO: 32563 - protein, 128 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARYYYDSSGYYYYYYYYGMDVWGQGTTVTVSS

SEQ ID NO: 32564 - protein, 123 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYSNYYYYYYGMDVWGQGTTVTVSS

SEQ ID NO: 32565 - protein, 120 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGYSGYDYYFDYWGQGTLVTVSS

SEQ ID NO: 32566 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREYSSSSDAFDIWGQGTMVTVSS

SEQ ID NO: 32567 - protein, 122 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARTTVTYYYYYGMDVWGQGTTVTVSS

SEQ ID NO: 32568 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGIAVAGYYYYYGMDVWGQGTTVTVSS

SEQ ID NO: 32569 - protein, 120 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDYGGNSDAFDIWGQGTMVTVSS

SEQ ID NO: 32570 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDYGGNSYYYYYGMDVWGQGTTVTVSS

SEQ ID NO: 32571 - protein, 123 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTLTGYYYYYGMDVWGQGTTVTVSS

SEQ ID NO: 32572 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYSNYYFDYWGQGTLVTVSS

SEQ ID NO: 32573 - protein, 121 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDYGDYAEYFQHWGQGTLVTVSS

SEQ ID NO: 32574 - protein, 118 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREYSSSSYFDYWGQGTLVTVSS

SEQ ID NO: 32575 - protein, 98 aa, Artificial Sequence; identical to SEQ ID NO: 32241
  Description of Artificial Sequence: Synthetic polypeptide

SEQ ID NO: 32576 - protein, 2 aa, Artificial Sequence
  Description of Artificial Sequence: Synthetic peptide
LR

SEQ ID NO: 32577 - protein, 21 aa, Artificial Sequence
  Description of Artificial Sequence: Synthetic peptide
LYYYYYGMDVWGQGTTVTVSS

SEQ ID NO: 32578 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSIAARYWYFDLWGRGTLVTVSS

SEQ ID NO: 32579 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARYNWNDYFDYWGQGTLVTVSS

SEQ ID NO: 32580 - protein, 120 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAREYSSSSYFDYWGQGTLVTVSS

SEQ ID NO: 32581 - protein, 127 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDIVVVVAATYYYYYGMDVWGQGTTVTVSS

SEQ ID NO: 32582 - protein, 103 aa, Artificial Sequence; identical to SEQ ID NO: 32413
  Description of Artificial Sequence: Synthetic polypeptide

SEQ ID NO: 32583 - protein, 18 aa, Artificial Sequence
  Description of Artificial Sequence: Synthetic peptide
LLFYFDYWGQGTLVTVSS

SEQ ID NO: 32584 - protein, 98 aa, Artificial Sequence; identical to SEQ ID NO: 32241
  Description of Artificial Sequence: Synthetic polypeptide

SEQ ID NO: 32585 - protein, 18 aa, Artificial Sequence
  Description of Artificial Sequence: Synthetic peptide
LGDAFDIWGQGTMVTVSS

SEQ ID NO: 32586 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYGGNSYYYYYGMDVWGQGTTVTVSS

SEQ ID NO: 32587 - protein, 120 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHGIAVAGYFDYWGQGTLVTVSS

SEQ ID NO: 32588 - protein, 98 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCAR

SEQ ID NO: 32589 - protein, 20 aa, Artificial Sequence
  Description of Artificial Sequence: Synthetic peptide
RWLQLYFDYWGQGTLVTVSS

SEQ ID NO: 32590 - protein, 120 aa, Artificial Sequence
  Description of Artificial Sequence: Synthetic polypeptide
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHEYSSSSYFDYWGQGTLVTVSS

SEQ ID NO: 32591 - protein, 123 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVQLERYYYYYGMDVWGQGTTVTVSS

SEQ ID NO: 32592 - protein, 118 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARTTVTNWFDPWGQGTLVTVSS

SEQ ID NO: 32593 - protein, 119 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGTTGTDAFDIWGQGTMVTVSS

SEQ ID NO: 32594 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDIVATIDAFDIWGQGTMVTVSS

SEQ ID NO: 32595 - protein, 99 aa, Artificial Sequence; identical to SEQ ID NO: 32442
  Description of Artificial Sequence: Synthetic polypeptide

SEQ ID NO: 32596 - protein, 2 aa, Artificial Sequence
  Description of Artificial Sequence: Synthetic peptide
LQ

SEQ ID NO: 32597 - protein, 16 aa, Artificial Sequence
  Description of Artificial Sequence: Synthetic peptide
LYFDYWGQGTLVTVSS

SEQ ID NO: 32598 - protein, 128 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARYYDILTGYYNYYYYYGMDVWGQGTTVTVSS

SEQ ID NO: 32599 - protein, 119 aa, Artificial Sequence; identical to SEQ ID NO: 32394
  Description of Artificial Sequence: Synthetic polypeptide

SEQ ID NO: 32600 - DNA, 22 bp, Artificial Sequence
  Description of Artificial Sequence: Synthetic primer
ttcatctttcttcccacattgc

SEQ ID NO: 32601 - DNA, 20 bp, Artificial Sequence
  Description of Artificial Sequence: Synthetic primer
gggcctgagagagacgttca

SEQ ID NO: 32602 - DNA, 23 bp, Artificial Sequence
  Description of Artificial Sequence: Synthetic primer
cactcaggtccttctgctgtttc

SEQ ID NO: 32603 - DNA, 18 bp, Artificial Sequence
  Description of Artificial Sequence: Synthetic primer
acctcgcctcctcctgct

SEQ ID NO: 32604 - DNA, 20 bp, Artificial Sequence
  Description of Artificial Sequence: Synthetic primer
gccagccctatcatgaccaa

SEQ ID NO: 32605 - DNA, 20 bp, Artificial Sequence
  Description of Artificial Sequence: Synthetic primer
gcaggtcgaggcattgaaga

SEQ ID NO: 32606 - DNA, 20 bp, Artificial Sequence
  Description of Artificial Sequence: Synthetic primer
taatacgactcactataggg

SEQ ID NO: 32607 - DNA, 18 bp, Artificial Sequence
  Description of Artificial Sequence: Synthetic primer
tagaaggcacagtcgagg

SEQ ID NO: 32608 - DNA, 23 bp, Artificial Sequence
  Description of Artificial Sequence: Synthetic primer
gaggcaatgtgggaagaaagatg

SEQ ID NO: 32609 - DNA, 29 bp, Artificial Sequence
  Description of Artificial Sequence: Synthetic primer
gaggcaatgtgggaagaaagatgaagtcg

SEQ ID NO: 32610 - DNA, 18 bp, Artificial Sequence
  Description of Artificial Sequence: Synthetic primer
ctgggcctccgtgctcgc

SEQ ID NO: 32611 - DNA, 23 bp, Artificial Sequence
  Description of Artificial Sequence: Synthetic primer
agaccttcagcatctggacaatg

SEQ ID NO: 32612 - DNA, 18 bp, Artificial Sequence
  Description of Artificial Sequence: Synthetic primer
cgaggtccggagcagaga

SEQ ID NO: 32613 - DNA, 17 bp, Artificial Sequence
  Description of Artificial Sequence: Synthetic probe
cagaaaagggccacctc

SEQ ID NO: 32614 - RNA, 19 nt, Artificial Sequence
  Description of Artificial Sequence: Synthetic oligonucleotide
acuucacagcgagcacgga

SEQ ID NO: 32615 - RNA, 19 nt, Artificial Sequence
  Description of Artificial Sequence: Synthetic oligonucleotide
gccaaggacuuucaagaua

SEQ ID NO: 32616 - RNA, 19 nt, Artificial Sequence
  Description of Artificial Sequence: Synthetic oligonucleotide
ugacggagguccaggcaau

SEQ ID NO: 32617 - RNA, 19 nt, Artificial Sequence
  Description of Artificial Sequence: Synthetic oligonucleotide
agugauggcucuuggaaau

SEQ ID NO: 32618 - RNA, 19 nt, Artificial Sequence
  Description of Artificial Sequence: Synthetic oligonucleotide
gacuauaggcacaacuaca

SEQ ID NO: 32619 - RNA, 19 nt, Artificial Sequence
  Description of Artificial Sequence: Synthetic oligonucleotide
cugugugacugggucccaa

SEQ ID NO: 32620 - RNA, 19 nt, Artificial Sequence
  Description of Artificial Sequence: Synthetic oligonucleotide
caccucuggcuaacccaua

SEQ ID NO: 32621 - RNA, 19 nt, Artificial Sequence
  Description of Artificial Sequence: Synthetic oligonucleotide
gagacaggcuuccagaauu

SEQ ID NO: 32622 - RNA, 19 nt, Artificial Sequence
  Description of Artificial Sequence: Synthetic oligonucleotide
ugaaguuaguggagucgaa

SEQ ID NO: 32623 - RNA, 19 nt, Artificial Sequence
  Description of Artificial Sequence: Synthetic oligonucleotide
agaucacuccaguuugcua

SEQ ID NO: 32624 - RNA, 19 nt, Artificial Sequence
  Description of Artificial Sequence: Synthetic oligonucleotide
ccaucaugacaaaggauua

SEQ ID NO: 32625 - RNA, 19 nt, Artificial Sequence
  Description of Artificial Sequence: Synthetic oligonucleotide
ggauggaacugauuauaga

SEQ ID NO: 32626 - RNA, 19 nt, Artificial Sequence
  Description of Artificial Sequence: Synthetic oligonucleotide
ggaauugggccuucacuca

SEQ ID NO: 32627 - RNA, 19 nt, Artificial Sequence
  Description of Artificial Sequence: Synthetic oligonucleotide
gacggaacaucacccacua

SEQ ID NO: 32628 - RNA, 19 nt, Artificial Sequence
  Description of Artificial Sequence: Synthetic oligonucleotide
ggauaggucuuaccgacag

SEQ ID NO: 32629 - RNA, 19 nt, Artificial Sequence
  Description of Artificial Sequence: Synthetic oligonucleotide
gcaggauccuaggauagaa

SEQ ID NO: 32630 - RNA, 19 nt, Artificial Sequence
  Description of Artificial Sequence: Synthetic oligonucleotide
acauugcucuuucaccuga

SEQ ID NO: 32631 - RNA, 19 nt, Artificial Sequence
  Description of Artificial Sequence: Synthetic oligonucleotide
gaagaguuucggacccuga

SEQ ID NO: 32632 - RNA, 19 nt, Artificial Sequence
  Description of Artificial Sequence: Synthetic oligonucleotide
acuucacacgcagcacgga

SEQ ID NO: 32633 - RNA, 19 nt, Artificial Sequence
  Description of Artificial Sequence: Synthetic oligonucleotide
gccaaggagaaucaagaua

SEQ ID NO: 32634 - RNA, 19 nt, Artificial Sequence
  Description of Artificial Sequence: Synthetic oligonucleotide
ugacggagcagcaggcaau

SEQ ID NO: 32635 - RNA, 19 nt, Artificial Sequence
  Description of Artificial Sequence: Synthetic oligonucleotide
agugaugggaguuggaaau

SEQ ID NO: 32636 - RNA, 19 nt, Artificial Sequence
  Description of Artificial Sequence: Synthetic oligonucleotide
gacuauagcgucaacuaca

SEQ ID NO: 32637 - RNA, 19 nt, Artificial Sequence
  Description of Artificial Sequence: Synthetic oligonucleotide
cugugugagacggucccaa

SEQ ID NO: 32638 - RNA, 19 nt, Artificial Sequence
  Description of Artificial Sequence: Synthetic oligonucleotide
caccucugcgaaacccaua

SEQ ID NO: 32639 - RNA, 19 nt, Artificial Sequence
  Description of Artificial Sequence: Synthetic oligonucleotide
gagacagggaaccagaauu

SEQ ID NO: 32640 - RNA, 19 nt, Artificial Sequence
  Description of Artificial Sequence: Synthetic oligonucleotide
ugaaguuacacgagucgaa

SEQ ID NO: 32641 - RNA, 19 nt, Artificial Sequence
  Description of Artificial Sequence: Synthetic oligonucleotide
agaucacugguguuugcua

SEQ ID NO: 32642 - RNA, 19 nt, Artificial Sequence
  Description of Artificial Sequence: Synthetic oligonucleotide
ccaucauguguaaggauua

SEQ ID NO: 32643 - RNA, 19 nt, Artificial Sequence
  Description of Artificial Sequence: Synthetic oligonucleotide
ggauggaagacauuauaga

SEQ ID NO: 32644 - RNA, 19 nt, Artificial Sequence
  Description of Artificial Sequence: Synthetic oligonucleotide
ggaauuggcgguucacuca

SEQ ID NO: 32645 - RNA, 19 nt, Artificial Sequence
  Description of Artificial Sequence: Synthetic oligonucleotide
gacggaacuagacccacua

SEQ ID NO: 32646 - RNA, 19 nt, Artificial Sequence
  Description of Artificial Sequence: Synthetic oligonucleotide
ggauaggugaaaccgacag

SEQ ID NO: 32647 - RNA, 19 nt, Artificial Sequence
  Description of Artificial Sequence: Synthetic oligonucleotide
gcaggaucgauggauagaa

SEQ ID NO: 32648 - RNA, 19 nt, Artificial Sequence
  Description of Artificial Sequence: Synthetic oligonucleotide
acauugcugaaucaccuga

SEQ ID NO: 32649 - RNA, 19 nt, Artificial Sequence
  Description of Artificial Sequence: Synthetic oligonucleotide
gaagaguuagcgacccuga

SEQ ID NO: 32650 - protein, 230 aa, Artificial Sequence
  Description of Artificial Sequence: Synthetic polypeptide
QVQLVQSGTEVKKPGASVKVSCKASGYTFTNYDINWVRQATGQGLEWMGWMHPNSGNTGYAQKFQGRVTLTRDTSISTAYMELSSLRSEDTAVYYCASSSGWYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGD

SEQ ID NO: 32651 - protein, 220 aa, Artificial Sequence
  Description of Artificial Sequence: Synthetic polypeptide
DIVMTQSPDSLAVSLGERATINCKSSQSILHSSNNNNYLAWFQQKPGQPPKLLLYWASTRESGVPDRFSGSGSGTDFTLTISSLQPEDVAVYYCQQYYNTPVTFGPGTKVGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32652 - protein, 461 aa, Artificial Sequence
  Description of Artificial Sequence: Synthetic polypeptide
QVQLVESGGGVVQPGRSLRLSCAASGFTFSSFGMHWVRQAPGKGLEWVAIIWHDGSNKYYADSVKGRFTISRDNSNNTLYLQMSSLRAEDTAVYYCARDLSMGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32653 - protein, 214 aa, Artificial Sequence
  Description of Artificial Sequence: Synthetic polypeptide
DIQMTQSPSSLSASVGDRVTIACRASQNIISYLNWYQQKPGKAPKFLIYTASSLQSGVPSRFSGSGSGTDFTLTISSLQPEDFAIYYCQQTYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32654 - protein, 227 aa, Artificial Sequence
  Description of Artificial Sequence: Synthetic polypeptide
QVQLVESGGGVVQPGRSLRLSCAASGFTFSSFGMHWVRQAPGKGLEWVAIIWHDGSNKYYADSVKGRFTISRDNSNNTLYLQMSSLRAEDTAVYYCARDLSMGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32655 - protein, 214 aa, Artificial Sequence; identical to SEQ ID NO: 32653
  Description of Artificial Sequence: Synthetic polypeptide

SEQ ID NO: 32656 - protein, 460 aa, Artificial Sequence
  Description of Artificial Sequence: Synthetic polypeptide
QVQLVQSGAEVKKPGASVKVSCKASGYTFTDYYLHWVRQAPGQGLEWMGWIHPNSGGTNYAQKFQGRVTMTRDTSISTAYMGLSSLRSDDTAVYYCARDGTSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32657 - protein, 214 aa, Artificial Sequence
  Description of Artificial Sequence: Synthetic polypeptide
DIQMTQSPSSVSASVGDRVTITCRASQGISRWLAWYQQKPGKAPKLLIYGASSLQSGVPSRFSGSGSGTDFTLTISSLQPEDFAIYYCQQANSFPFTFGPGTKVDIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32658 - protein, 226 aa, Artificial Sequence
  Description of Artificial Sequence: Synthetic polypeptide
QVQLVQSGAEVKKPGASVKVSCKASGYTFTDYYLHWVRQAPGQGLEWMGWIHPNSGGTNYAQKFQGRVTMTRDTSISTAYMGLSSLRSDDTAVYYCARDGTSSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32659 - protein, 214 aa, Artificial Sequence; identical to SEQ ID NO: 32657
  Description of Artificial Sequence: Synthetic polypeptide

SEQ ID NO: 32660 - protein, 460 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYFCARGGSRGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32661 - protein, 214 aa, Artificial Sequence
  Description of Artificial Sequence: Synthetic polypeptide
DIQMTQSPSSLSASVGDRVTITCRASQSITSYLNWYQQKPGKAPKLLIYTASSLQSGVPSRFSGSGSGTDFTLTISSLQPEDFATYYCQQSHSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32662 - protein, 226 aa, Artificial Sequence
  Description of Artificial Sequence: Synthetic polypeptide
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYFCARGGSRGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32663 - protein, 214 aa, Artificial Sequence; identical to SEQ ID NO: 32661
  Description of Artificial Sequence: Synthetic polypeptide

SEQ ID NO: 32664 - protein, 459 aa, Artificial Sequence
  Description of Artificial Sequence: Synthetic polypeptide
QVQLVQSGTEVKKPGASLKVSCKASGYTFTVYYLNWVRQAPGQGLEWMGWINPNSGGTNYAQKFQGRVTMTRDTSISTAYMELSRLRSDDTAVYYCARGYDILTGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32665 - protein, 215 aa, Artificial Sequence
  Description of Artificial Sequence: Synthetic polypeptide
EIVLTQSPGTLSLSPGERATLSCRASRGVSNIYLAWYQQKPGQAPRLLIYGASNRATGIPDRFSGSGSGTDFTLTISRLEPEDFAVYYCQHNDYSMFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32666 - protein, 225 aa, Artificial Sequence
  Description of Artificial Sequence: Synthetic polypeptide
QVQLVQSGTEVKKPGASLKVSCKASGYTFTVYYLNWVRQAPGQGLEWMGWINPNSGGTNYAQKFQGRVTMTRDTSISTAYMELSRLRSDDTAVYYCARGYDILTGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32667 - protein, 215 aa, Artificial Sequence; identical to SEQ ID NO: 32665
  Description of Artificial Sequence: Synthetic polypeptide

SEQ ID NO: 32668 - protein, 465 aa, Artificial Sequence
  Description of Artificial Sequence: Synthetic polypeptide
QVQLVQSGAEVKKPGASVKVSCKASGYTFNSYGISWVRLAPGQGLEWMGWISAYNGNTKNAQKLQGRVTMTTDTSTSTAYMELRSLRSDDTAVYYCARHDFWSGYYKGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32669 - protein, 216 aa, Artificial Sequence
  Description of Artificial Sequence: Synthetic polypeptide
QSVLTQPPSASGTPGQRVTISCSGSNSNIGNNIVTWYQQLPGTAPKLLIYVNDQRPSGVPDRFSGSKSGTSASLAISGLQSEDEADYYCAAWDDSLNGWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 32670 - protein, 231 aa, Artificial Sequence
  Description of Artificial Sequence: Synthetic polypeptide
QVQLVQSGAEVKKPGASVKVSCKASGYTFNSYGISWVRLAPGQGLEWMGWISAYNGNTKNAQKLQGRVTMTTDTSTSTAYMELRSLRSDDTAVYYCARHDFWSGYYKGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32671 - protein, 216 aa, Artificial Sequence; identical to SEQ ID NO: 32669
  Description of Artificial Sequence: Synthetic polypeptide

SEQ ID NO: 32672 - protein, 462 aa, Artificial Sequence
  Description of Artificial Sequence: Synthetic polypeptide
QVQLVESGGGVVQPGRSLRLSCAASGFTFSSYGLHWVRQAPGKGLEWVAVIWYDGSNKYYADSVKGRFTISRDNSKNTLYLQMNSLRVEDTAVYYCANWYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32673 - protein, 216 aa, Artificial Sequence
  Description of Artificial Sequence: Synthetic polypeptide
QSVLTQPPSVSAAPGQKVTISCSGSSSNIGNNYVSWYQQLPGTAPKLLLYDSNKRPSGIPARFSGSKSGTSATLGITGLQTGDEADYYCGTWDSSLNTVVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 32674 - protein, 228 aa, Artificial Sequence
  Description of Artificial Sequence: Synthetic polypeptide
QVQLVESGGGVVQPGRSLRLSCAASGFTFSSYGLHWVRQAPGKGLEWVAVIWYDGSNKYYADSVKGRFTISRDNSKNTLYLQMNSLRVEDTAVYYCANWYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32675 - protein, 464 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSYKYYADSVKGRFTISRDNSKNTLYLQMSSLRAEDTAVYYCARDAHDFWSGYFAYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32676 - protein, 219 aa, Artificial Sequence
  Description of Artificial Sequence: Synthetic polypeptide
DIVMTQTPLSLSVTPGQPASISCKSSQSLLHGDGKTYLYWYLQKPGQPPQLLIYEVSNRFSGVPDRFSGSGSGTDFTLKISRVEAEDVGIYYCMQSIQIPWTFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32677 - protein, 230 aa, Artificial Sequence
  Description of Artificial Sequence: Synthetic polypeptide
QVQLVESGGGVVQPGRSLRLSCAASGFTFSSYGMHWVRQAPGKGLEWVAIIWYDGSYKYYADSVKGRFTISRDNSKNTLYLQMSSLRAEDTAVYYCARDAHDFWSGYFAYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32678 - protein, 219 aa, Artificial Sequence
  Description of Artificial Sequence: Synthetic polypeptide
QVQLQQWGAGLLKPSETLSLTCAVSGGSFRYYYWSWIRQPPGKGLEWFGEINHAGSTNYNPSLKSRVTISIDTSKNQFSLKLRSVTAADTAVYYCARDYGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCG

SEQ ID NO: 32679 - protein, 215 aa, Artificial Sequence
  Description of Artificial Sequence: Synthetic polypeptide
EIVLTQSPGTLSLSPGERATLSCRASPSVNSGYLAWYQQKPGQTPRLLIFGASSRATGIPDRFSASGSGADFTLTISRLEPEDFAVYFCQQYESSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32680 - protein, 224 aa, Artificial Sequence
  Description of Artificial Sequence: Synthetic polypeptide
QVQLQQWGAGLLKPSETLSLTCAVSGGSFRYYYWSWIRQPPGKGLEWFGEINHAGSTNYNPSLKSRVTISIDTSKNQFSLKLRSVTAADTAVYYCARDYGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32681 - protein, 106 aa, Artificial Sequence
  Description of Artificial Sequence: Synthetic polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 32682 - protein, 106 aa, Artificial Sequence
  Description of Artificial Sequence: Synthetic polypeptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 32683 - protein, 105 aa, Artificial Sequence
  Description of Artificial Sequence: Synthetic polypeptide
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 32684 - protein, 106 aa, Artificial Sequence
  Description of Artificial Sequence: Synthetic polypeptide
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 32685 - protein, 106 aa, Artificial Sequence
  Description of Artificial Sequence: Synthetic polypeptide
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 32686 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32687 - protein, 107 aa, Homo sapiens [sequence omitted]

SEQ ID NO: 32688 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32689 - protein, 330 aa, Homo sapiens [sequence omitted]

SEQ ID NO: 32690 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32691 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32692 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 32693 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 32694 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32695 - protein, 466 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCTREVYSSGWYDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVDGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGHHHHHH

SEQ ID NO: 32696 - protein, 214 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32697 - protein, 232 aa, Artificial Sequence
  Description of Artificial Sequence: Synthetic polypeptide
QVQLVESGGGVVQPGRSLRLSCAASGFTFSNYVMHWVRQAPGKGLEWVAVIWYDGSNKYYADSVKGRFTISRDNSKNTLYLQMNSLRAEDTAVYYCTREVYSSGWYDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSDEVD

SEQ ID NO: 32698 - protein, 214 aa, Artificial Sequence; identical to SEQ ID NO: 32696
  Description of Artificial Sequence: Synthetic polypeptide

SEQ ID NO: 32699 - protein, 291 aa, Homo sapiens; identical to SEQ ID NO: 5

SEQ ID NO: 32700 - protein, 291 aa, Macaca fascicularis; identical to SEQ ID NO: 48

SEQ ID NO: 32701 - protein, 284 aa, Canis lupus familiaris; identical to SEQ ID NO: 73

SEQ ID NO: 32702 - protein, 286 aa, Sus scrofa; identical to SEQ ID NO: 74

SEQ ID NO: 32703 - protein, 284 aa, Rattus norvegicus; identical to SEQ ID NO: 54

SEQ ID NO: 32704 - protein, 284 aa, Mus musculus; identical to SEQ ID NO: 1

SEQ ID NO: 32705 - protein, 291 aa, Homo sapiens; identical to SEQ ID NO: 5

SEQ ID NO: 32706 - protein, 252 aa, Homo sapiens
MTKEYQDLQHLDNEESDHHQLRKDSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 32707 - protein, 190 aa, Homo sapiens
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 32708 - protein, 151 aa, Homo sapiens
MAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 32709 - protein, 133 aa, Homo sapiens
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFK

SEQ ID NO: 32710 - protein, 94 aa, Homo sapiens
MAALQGNGSERTCCPVNWVEHERSCYWFSRSGKAWADADNYCRLEDAHLVVVTSWEEQKFVQHHIGPVNTWMGLHDQNGPWKWVDGTDYETGFK

SEQ ID NO: 32711 - protein, 301 aa, Mus musculus; identical to SEQ ID NO: 2

SEQ ID NO: 32712 - protein, 301 aa, Rattus norvegicus; identical to SEQ ID NO: 62

SEQ ID NO: 32713 - protein, 287 aa, Homo sapiens; identical to SEQ ID NO: 6

SEQ ID NO: 32714 - protein, 306 aa, Macaca fascicularis
MAKDFQDIQQLSSEENDHPFHRGEGPGPRGLNLRRGNPSLKGPPPAQPLAQRLCSMVRFSLLALSFNILLLVAICVIGSQSAQLQAEMRSLKEAFSNFSSSTLMEVHALGTHGGSVGDKITSLGDKLEKQQQDLKADHDILLLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAA

SEQ ID NO: 32715 - protein, 283 aa, Sus scrofa; identical to SEQ ID NO: 72

SEQ ID NO: 32716 - protein, 302 aa, Canis lupus familiaris; identical to SEQ ID NO: 67

SEQ ID NO: 32717 - protein, 291 aa, Homo sapiens; identical to SEQ ID NO: 5

SEQ ID NO: 32718 - protein, 287 aa, Homo sapiens; identical to SEQ ID NO: 6

SEQ ID NO: 32719-50000 - skipped (17282 entries)

SEQ ID NO: 50001 - protein, 5 aa, Artificial
  Synthetic
  MISC_FEATURE (1)..(1): X = N or H
  MISC_FEATURE (4)..(4): X = I or V or H
  MISC_FEATURE (4)..(4): X = I or V or L
XYDXN

SEQ ID NO: 50002 - protein, 17 aa, Artificial
  Synthetic
  MISC_FEATURE (1)..(1): X = W or R
  MISC_FEATURE (2)..(2): X = M or V or L
  MISC_FEATURE (3)..(3): X = H or N or Y or T
  MISC_FEATURE (5)..(5): X = N or D or H
  MOD_RES (7)..(9): Any amino acid
  MISC_FEATURE (10)..(10): X = G or H
  MISC_FEATURE (11)..(11): X = N or S or Q or A or D or K or T
  MISC_FEATURE (12)..(12): X = T or A or V or E
  MISC_FEATURE (13)..(13): X = G or D
  MISC_FEATURE (14)..(14): X = Y or F or C
  MISC_FEATURE (15)..(15): X = A or P
  MISC_FEATURE (16)..(16): X = Q or K
  MISC_FEATURE (17)..(17): X = K or R or N
  MISC_FEATURE (19)..(19): X = Q or R
  MISC_FEATURE (20)..(20): X = G or V
XXXPXSXXXXXXXXFXX

SEQ ID NO: 50003 - protein, 9 aa, Artificial
  Synthetic
  MISC_FEATURE (5)..(5): X = Y or E or N or T
  MISC_FEATURE (6)..(6): X = Y or F or K or I or R or V or L or M or W or H or S
  MISC_FEATURE (9)..(9): X = Y or F or S or N
SSGWXXFDX

SEQ ID NO: 50004 - protein, 5 aa, Artificial
  Synthetic
  MISC_FEATURE (1)..(1): X = S or D or N or I
  MISC_FEATURE (2)..(2): X = Y or C or F or D or S
  MISC_FEATURE (3)..(3): X = V or G or I or L
  MISC_FEATURE (4)..(4): X = M or I or L
  MISC_FEATURE (5)..(5): X = H or D
XXXXX

SEQ ID NO: 50005 - protein, 17 aa, Artificial
  Synthetic
  MISC_FEATURE (1)..(1): X = V or L or A
  MISC_FEATURE (3)..(3): X = W or F
  MISC_FEATURE (6)..(6): X = G or A
  MISC_FEATURE (7)..(7): X = S or R or N
  MISC_FEATURE (8)..(8): X = N or Y or G or S
  MISC_FEATURE (10)..(10): X = Y or H
  MISC_FEATURE (11)..(11): X = Y or H or N
  MISC_FEATURE (12)..(12): X = A or V or E or G or T
  MISC_FEATURE (13)..(13): X = D or E or G
  MISC_FEATURE (14)..(14): X = S or A
  MISC_FEATURE (15)..(15): X = V or M
XIXYDXXXKXXXXXXKG

SEQ ID NO: 50006 - protein, 20 aa, Artificial
  Synthetic
  MISC_FEATURE (1)..(1): X = E or R or V
  MISC_FEATURE (2)..(2): X = R or Y or K or V or E or P or D or L or F or M or N or Q or T
  MISC_FEATURE (3)..(3): X = Y or S or T or V
  MISC_FEATURE (4)..(4): X = S or R or Y or P or T or G
  MISC_FEATURE (5)..(5): X = S or C or Y
  MISC_FEATURE (6)..(6): X = G or W or S or N
  MISC_FEATURE (7)..(7): X = W or Absent or L or Y or G or F or S
  MISC_FEATURE (8)..(8): X = Absent or Y
  MISC_FEATURE (9)..(9): X = Absent or A or G or T
  MISC_FEATURE (10)..(10): X = Absent or C
  MISC_FEATURE (11)..(11): X = Absent or P
  MISC_FEATURE (12)..(12): X = Absent or Y or L
  MISC_FEATURE (13)..(13): X = Absent or Y or D
  MISC_FEATURE (14)..(14): X = Y or Absent or F or H
  MISC_FEATURE (15)..(15): X = D or S or G or T or V or Y or A or F or M
  MISC_FEATURE (16)..(16): X = Y or G or F
  MISC_FEATURE (18)..(18): X = M or L
  MISC_FEATURE (19)..(19): X = D or G
XXXXXXXXXXXXXXXXGXXV

SEQ ID NO: 50007 - protein, 5 aa, Artificial
  Synthetic
  MISC_FEATURE (1)..(1): X = D or S or N or T
  MISC_FEATURE (2)..(2): X = Y or F
  MISC_FEATURE (4)..(4): X = M or I
XXGXH

SEQ ID NO: 50008 - protein, 17 aa, Artificial
  Synthetic
  MISC_FEATURE (1)..(1): X = V or L
  MISC_FEATURE (2)..(2): X = I or V or T or M
  MISC_FEATURE (4)..(4): X = Y or F or D
  MISC_FEATURE (5)..(5): X = D or E or A or G or N
  MISC_FEATURE (6)..(6): X = E or G or V or R or D
  MISC_FEATURE (7)..(7): X = S or T or D or I or Y
  MISC_FEATURE (7)..(7): X = N or S or T or D or I or Y
  MISC_FEATURE (8)..(8): X = N or H or K
  MISC_FEATURE (9)..(9): X = K or Q or E or N or R
  MISC_FEATURE (10)..(10): X = Y or H or K or D or R or S
  MISC_FEATURE (11)..(11): X = Y or H
  MISC_FEATURE (12)..(12): X = A or V or G or T or I or E
  MISC_FEATURE (13)..(13): X = D or E
  MISC_FEATURE (15)..(15): X = V or M
  MISC_FEATURE (16)..(16): X = K or R
XXWXXXXXXXXXXSXXG

SEQ ID NO: 50009 - protein, 8 aa, Artificial
  Synthetic
  MISC_FEATURE (1)..(1): X = E or D or G
  MISC_FEATURE (3)..(3): X = G or A
  MISC_FEATURE (4)..(4): X = F or W or M
  MISC_FEATURE (5)..(5): X = L or R or T or Y or S or Q or I or A or E or N
  MISC_FEATURE (6)..(6): X = S or E or G or D or F or N or A or T
  MISC_FEATURE (7)..(7): X = D or E
  MISC_FEATURE (8)..(8): X = Y or S or F or C
XLXXXXXX

SEQ ID NO: 50010 - protein, 5 aa, Artificial
  Synthetic
  MISC_FEATURE (2)..(2): X = C or S or P or Y
GXYWS

SEQ ID NO: 50011 - protein, 16 aa, Artificial
  Synthetic
  MISC_FEATURE (4)..(4): X = Hor Y or Q
  MISC_FEATURE (4)..(4): X = H or Y or Q
  MISC_FEATURE (5)..(5): X = S or R
  MISC_FEATURE (7)..(7): X = S or R or C or I
  MISC_FEATURE (9)..(9): X = N or S
  MISC_FEATURE (10)..(10): X = Y or F
  MISC_FEATURE (15)..(15): X = K or T
EINXXGXTXXNPSLXS

SEQ ID NO: 50012 - protein, 7 aa, Artificial
  Synthetic
  MISC_FEATURE (5)..(5): X = M or L or I
DYGGXDV

SEQ ID NO: 50013 - protein, 5 aa, Artificial
  Synthetic
NYDIN

SEQ ID NO: 50014 - protein, 17 aa, Artificial
  Synthetic
  MISC_FEATURE (3)..(3): X = H or N or Y
  MISC_FEATURE (5)..(5): X = N or D
  MISC_FEATURE (6)..(6): X = S or N
  MISC_FEATURE (7)..(7): X = G or V
  MISC_FEATURE (8)..(8): N or S
  MISC_FEATURE (8)..(8): X = N or S
  MISC_FEATURE (9)..(9): X = T or I
  MISC_FEATURE (11)..(11): X = Y or F or C
  MISC_FEATURE (17)..(17): X = G or D
WMXPXXXXXGXAQKFQX

SEQ ID NO: 50015 - protein, 9 aa, Artificial
  Synthetic
  MISC_FEATURE (5)..(5): X = Y or H or N or S or K
  MISC_FEATURE (6)..(6): X = W or R
SSGWXXFDP

SEQ ID NO: 50016 - protein, 5 aa, Artificial
  Synthetic
  MISC_FEATURE (1)..(1): X = S or N or R or T or I
  MISC_FEATURE (2)..(2): X = Y or H or N
  MISC_FEATURE (5)..(5): X = H or D
XXGMX

SEQ ID NO: 50017 - protein, 17 aa, Artificial
  Synthetic
  MISC_FEATURE (1)..(1): X = V or I
  MISC_FEATURE (2)..(2): X = I or L
  MISC_FEATURE (4)..(4): X = Y or F
  MISC_FEATURE (7)..(7): X = S or T
  MISC_FEATURE (9)..(9): X = K or E or Q or D or R
  MISC_FEATURE (10)..(10): X = N or H or Y
  MISC_FEATURE (11)..(11): X = Y or H
  MISC_FEATURE (12)..(12): X = A or V or G
  MISC_FEATURE (13)..(13): X = D or E
XXWXDGXNXXXXXSVKG

SEQ ID NO: 50018 - protein, 16 aa, Artificial
  Synthetic
  MISC_FEATURE (1)..(1): X = D or A
  MISC_FEATURE (2)..(2): X = Q or R or Y or H or A or C or E or F or M
  MISC_FEATURE (4)..(4): X = V or I or F
  MISC_FEATURE (5)..(5): X = G or Y
  MISC_FEATURE (6)..(6): X = Y or E
  MISC_FEATURE (7)..(7): X = Absent or F
  MISC_FEATURE (8)..(8): X = Absent or D
  MISC_FEATURE (9)..(9): X = Absent or Y
  MISC_FEATURE (10)..(10): X = Absent or Y
  MISC_FEATURE (11)..(11): X = Absent or N
  MISC_FEATURE (12)..(12): X = Y or D or N
  MISC_FEATURE (13)..(13): X = G or A or D
  MISC_FEATURE (14)..(14): X = L or M or T or I
XXGXXXXXXXXXXXDV

SEQ ID NO: 50019 - protein, 5 aa, Artificial
  Synthetic
  MISC_FEATURE (1)..(1): X = G or D or S or A
  MISC_FEATURE (2)..(2): X = Y or D
  MISC_FEATURE (3)..(3): X = Y or H or N or F
  MISC_FEATURE (4)..(4): X = M or L or I
  MISC_FEATURE (5)..(5): X = H or Q
XXXXX

SEQ ID NO: 50020 - protein, 17 aa, Artificial
  Synthetic
  MISC_FEATURE (2)..(2): X = I or V
  MISC_FEATURE (3)..(3): X = N or H or K or S
  MISC_FEATURE (5)..(5): X = N or K
  MISC_FEATURE (6)..(6): X = S or N or R or T
  MISC_FEATURE (7)..(7): X = G or N or D
  MISC_FEATURE (8)..(8): X = G or A
  MISC_FEATURE (9)..(9): X = T or S
  MISC_FEATURE (10)..(10): X = N or H or Q or I
  MISC_FEATURE (11)..(11): X = Y or S or F
  MISC_FEATURE (12)..(12): X = A or T
  MISC_FEATURE (14)..(14): X = K or R or N or E or S
  MISC_FEATURE (17)..(17): X = G or D
WXXPXXXXXXXXQXFQX

SEQ ID NO: 50021 - protein, 13 aa, Artificial
  Synthetic
  MISC_FEATURE (1)..(1): X = D or K or G or S or E
  MISC_FEATURE (2)..(2): X = G or F or A or K or V
  MISC_FEATURE (3)..(3): X = T or Absent or P
  MISC_FEATURE (4)..(4): X = S or G or Absent or T
  MISC_FEATURE (5)..(5): X = Absent or V or S
  MISC_FEATURE (6)..(6): X = Absent or A
  MISC_FEATURE (7)..(7): X = Absent or T
  MISC_FEATURE (8)..(8): X = Absent or W
  MISC_FEATURE (9)..(9): X = Absent or G
  MISC_FEATURE (10)..(10): X = S or Absent or V or Y
  MISC_FEATURE (11)..(11): X = F or Absent or L or Y
  MISC_FEATURE (12)..(12): X = D or G or K
  MISC_FEATURE (13)..(13): X = Y or D or F
XXXXXXXXXXXXX

SEQ ID NO: 50022 - protein, 5 aa, Artificial
  Synthetic
  MISC_FEATURE (1)..(1): X = S or N
  MISC_FEATURE (2)..(2): X = Y or F or H
  MISC_FEATURE (4)..(4): X = M or I
XXGXH

SEQ ID NO: 50023 - protein, 17 aa, Artificial
  Synthetic
  MISC_FEATURE (1)..(1): X = V or I
  MISC_FEATURE (3)..(3): X = W or I
  MISC_FEATURE (4)..(4): X = H or Y or F or N
  MISC_FEATURE (5)..(5): X = D or S or E
  MISC_FEATURE (6)..(6): X = G or A
  MISC_FEATURE (7)..(7): X = S or G
  MISC_FEATURE (8)..(8): X = N or Y
  MISC_FEATURE (9)..(9): X = K or D or E or R
  MISC_FEATURE (10)..(10): X = Y or N
  MISC_FEATURE (11)..(11): X = Y or N
  MISC_FEATURE (12)..(12): X = A or V or G
  MISC_FEATURE (13)..(13): X = D or E
  MISC_FEATURE (14)..(14): X = S or A
  MISC_FEATURE (16)..(16): X = K or R
XIXXXXXXXXXXXXVXG

SEQ ID NO: 50024 - protein, 21 aa, Artificial
  Synthetic
  MISC_FEATURE (1)..(1): X = D or T or R
  MISC_FEATURE (2)..(2): X = L or R or Y or S or F or I or P
  MISC_FEATURE (3)..(3): X = S or R or T
  MISC_FEATURE (4)..(4): X = M or V or G or P or K or N or Y
  MISC_FEATURE (5)..(5): X = G or Y or Absent or S
  MISC_FEATURE (6)..(6): X = Absent or Y or S or W
  MISC_FEATURE (7)..(7): X = Absent or G
  MISC_FEATURE (8)..(8): X = Absent or S
  MISC_FEATURE (9)..(9): X = Absent or G
  MISC_FEATURE (10)..(10): X = Absent or S
  MISC_FEATURE (11)..(11): X = Absent or P
  MISC_FEATURE (12)..(12): X = Absent or P
  MISC_FEATURE (13)..(13): X = Absent or Y
  MISC_FEATURE (14)..(14): X = Absent or Y
  MISC_FEATURE (15)..(15): X = Absent or Y
  MISC_FEATURE (16)..(16): X = Absent or S or Y
  MISC_FEATURE (17)..(17): X = Absent or D or Y or G
  MISC_FEATURE (19)..(19): X = M or L or T
XXXXXXXXXXXXXXXXXGXDV

SEQ ID NO: 50025 - protein, 5 aa, Artificial
  Synthetic
  MISC_FEATURE (1)..(1): X = D or N or S
  MISC_FEATURE (2)..(2): X = Y or F
  MISC_FEATURE (4)..(4): X = M or I or L
XXGXH

SEQ ID NO: 50026 - protein, 17 aa, Artificial
  Synthetic
  MISC_FEATURE (4)..(4): X = Y or F
  MISC_FEATURE (5)..(5): X = D or E or I or V
  MISC_FEATURE (6)..(6): X = E or G or V or A or R
  MISC_FEATURE (7)..(7): X = S or N or T or G
  MISC_FEATURE (9)..(9): X = K or Q or T or N
  MISC_FEATURE (10)..(10): X = Y or H or K
  MISC_FEATURE (12)..(12): X = A or T or G or E or V
  MISC_FEATURE (13)..(13): X = D or G
  MISC_FEATURE (15)..(15): X = V or A
VIWXXXXNXXYXXSXKG

SEQ ID NO: 50027 - protein, 8 aa, Artificial
  Synthetic
  MISC_FEATURE (2)..(2): X = V or I or M or K or T
  MISC_FEATURE (4)..(4): X = W or F or G or M
  MISC_FEATURE (5)..(5): X = L or T or S or Y or H or R
  MISC_FEATURE (6)..(6): X = D or E or S or F or N
  MISC_FEATURE (8)..(8): X = Y or C
EXGXXXDX

SEQ ID NO: 50028 - protein, 5 aa, Artificial
  Synthetic
  MISC_FEATURE (1)..(1): X = S or T
  MISC_FEATURE (2)..(2): X = Y or F
  MISC_FEATURE (3)..(3): X = S or T or G or R
  MISC_FEATURE (4)..(4): X = M or L
XXXXN

SEQ ID NO: 50029 - protein, 17 aa, Artificial
  Synthetic
  MISC_FEATURE (1)..(1): X = S or A or C or L
  MISC_FEATURE (4)..(4): X = G or S
  MISC_FEATURE (6)..(6): X = S or G or T
  MISC_FEATURE (7)..(7): X = S or T or G or Y
  MISC_FEATURE (8)..(8): X = Y or H
  MISC_FEATURE (9)..(9): X = I or L or M
  MISC_FEATURE (10)..(10): X = Y or S or W
  MISC_FEATURE (12)..(12): X = A or G or P or V
  MISC_FEATURE (15)..(15): X = V or L
  MISC_FEATURE (17)..(17): X = G or A
XISXSXXXXXYXDSXKX

SEQ ID NO: 50030 - protein, 8 aa, Artificial
  Synthetic
  MISC_FEATURE (1)..(1): X = D or T
  MISC_FEATURE (3)..(3): X = G or Absent or S or Y
  MISC_FEATURE (4)..(4): X = Absent or G
  MISC_FEATURE (5)..(5): X = Absent or S
  MISC_FEATURE (6)..(6): X = Absent or F or S
  MISC_FEATURE (7)..(7): X = S or D or G or H
  MISC_FEATURE (8)..(8): X = S or L or Y or G or T or C or E or I
XRXXXXXX

SEQ ID NO: 50031 - protein, 5 aa, Artificial
  Synthetic
  MISC_FEATURE (1)..(1): X = S or G
  MISC_FEATURE (3)..(3): X = A or V
  MISC_FEATURE (5)..(5): X = S or N or T
XYXMX

SEQ ID NO: 50032 - protein, 17 aa, Artificial
  Synthetic
  MISC_FEATURE (1)..(1): X = V or I or A
  MISC_FEATURE (4)..(4): X = G or R
  MISC_FEATURE (5)..(5): X = R or S
  MISC_FEATURE (7)..(7): X = G or V or I or T
  MISC_FEATURE (8)..(8): X = N or Y or S or T
  MISC_FEATURE (9)..(9): X = T or A
  MISC_FEATURE (10)..(10): X = F or Y
  MISC_FEATURE (11)..(11): X = Y or N or S
  MISC_FEATURE (16)..(16): X = K or R
XISXXGXXXXXADSVXG

SEQ ID NO: 50033 - protein, 12 aa, Artificial
  Synthetic
  MISC_FEATURE (2)..(2): X = I or L or M or V
  MISC_FEATURE (5)..(5): X = A or D
  MISC_FEATURE (7)..(7): X = S or N or Y
  MISC_FEATURE (8)..(8): X = E or D
  MISC_FEATURE (10)..(10): X = F or C
  MISC_FEATURE (11)..(11): X = D or A or H
  MISC_FEATURE (12)..(12): X = I or V
RXAVXGXXAXXX

SEQ ID NO: 50034 - protein, 5 aa, Artificial
  Synthetic
  MISC_FEATURE (1)..(1): X = S or N
  MISC_FEATURE (2)..(2): X = Y or C
  MISC_FEATURE (3)..(3): X = A or V
  MISC_FEATURE (5)..(5): X = S or N
XXXMX

SEQ ID NO: 50035 - protein, 17 aa, Artificial
  Synthetic
  MISC_FEATURE (1)..(1): X = A or T or S
  MISC_FEATURE (2)..(2): X = I or L
  MISC_FEATURE (4)..(4): X = G or R or V
  MISC_FEATURE (5)..(5): X = R or G
  MISC_FEATURE (8)..(8): X = S or N
  MISC_FEATURE (9)..(9): X = T or I
  MISC_FEATURE (10)..(10): X = F or Y
  MISC_FEATURE (11)..(11): X = H or Y or N
  MISC_FEATURE (15)..(15): X = V or E or M
XXSXXGGXXXXADSXKG

SEQ ID NO: 50036 - protein, 15 aa, Artificial
  Synthetic
  MISC_FEATURE (1)..(1): X = G or W
  MISC_FEATURE (2)..(2): X = E or G
  MISC_FEATURE (5)..(5): X = E or Y
  MISC_FEATURE (6)..(6): X = D or S or N
  MISC_FEATURE (8)..(8): X = Absent or E
  MISC_FEATURE (9)..(9): X = Y or S
  MISC_FEATURE (10)..(10): X = F or Y
  MISC_FEATURE (11)..(11): X = Y or F
  MISC_FEATURE (12)..(12): X = G or A
  MISC_FEATURE (13)..(13): X = M or I or L
XXLLXXYXXXXXXDV

SEQ ID NO: 50037 - protein, 5 aa, Artificial
  Synthetic
  MISC_FEATURE (1)..(1): X = S or G or D or R or H or T or N
  MISC_FEATURE (3)..(3): X = G or V
  MISC_FEATURE (4)..(4): X = M or L
  MISC_FEATURE (5)..(5): X = H or N
XYXXX

SEQ ID NO: 50038 - protein, 17 aa, Artificial
  Synthetic
  MISC_FEATURE (1)..(1): X = V or L or F or I or D
  MISC_FEATURE (2)..(2): X = I or F
  MISC_FEATURE (3)..(3): X = W or R
  MISC_FEATURE (4)..(4): X = Y or F
  MISC_FEATURE (7)..(7): X = S or N or T
  MISC_FEATURE (8)..(8): X = N or E or D or K
  MISC_FEATURE (9)..(9): X = K or N or T
  MISC_FEATURE (10)..(10): X = Y or N
  MISC_FEATURE (10)..(10): X = Y or S or D or N
  MISC_FEATURE (11)..(11): X = Y or N
  MISC_FEATURE (12)..(12): X = A or V
  MISC_FEATURE (17)..(17): X = G or D
XXXXDGXXXXXXDSVKX

SEQ ID NO: 50039 - protein, 21 aa, Artificial
  Synthetic
  MISC_FEATURE (2)..(2): X = R or D or W or N
  MISC_FEATURE (3)..(3): X = V or D or R or F or H
  MISC_FEATURE (4)..(4): X = Y or S or E or G or F
  MISC_FEATURE (5)..(5): X = C or G or E
  MISC_FEATURE (6)..(6): X = S or G
  MISC_FEATURE (7)..(7): X = S or G or R or N
  MISC_FEATURE (8)..(8): X = T or Absent or S or P
  MISC_FEATURE (9)..(9): X = S or P or Absent or T
  MISC_FEATURE (10)..(10): X = C or Absent
  MISC_FEATURE (11)..(11): X = Absent or S or H or L or Y
  MISC_FEATURE (12)..(12): X = P or Absent or S or Y
  MISC_FEATURE (13)..(13): X = Y or Absent
  MISC_FEATURE (14)..(14): X = Y or Absent
  MISC_FEATURE (15)..(15): X = Y or Absent
  MISC_FEATURE (16)..(16): X = Y or F
  MISC_FEATURE (18)..(18): X = G or A
  MISC_FEATURE (19)..(19): X = M or L
DXXXXXXXXXXXXXXXYXXDV

SEQ ID NO: 50040 - protein, 5 aa, Artificial
  Synthetic
  MISC_FEATURE (1)..(1): X = S or N
  MISC_FEATURE (3)..(3): X = S or T or K or N or R
  MISC_FEATURE (4)..(4): X = M or L
XYXXN

SEQ ID NO: 50041 - protein, 17 aa, Artificial
  Synthetic
  MISC_FEATURE (2)..(2): X = I or T
  MISC_FEATURE (4)..(4): X = G or S
  MISC_FEATURE (5)..(5): X = S or G or N or T
  MISC_FEATURE (6)..(6): X = S or G or D or N
  MISC_FEATURE (7)..(7): X = S or T
  MISC_FEATURE (8)..(8): X = Y or F or D or L or N or S
  MISC_FEATURE (9)..(9): X = I or M or T
  MISC_FEATURE (10)..(10): X = Y or N
  MISC_FEATURE (12)..(12): X = A or T
SXSXXXXXXXYXDSVKG

SEQ ID NO: 50042 - protein, 6 aa, Artificial
  Synthetic
  MISC_FEATURE (2)..(2): X = A or N or S
  MISC_FEATURE (3)..(3): X = S or A or G or T or L or H or N
  MISC_FEATURE (4)..(4): X = F or L or N
  MISC_FEATURE (6)..(6): X = Y or C or S
VXXXDX

SEQ ID NO: 50043 - protein, 5 aa, Artificial
  Synthetic
  MISC_FEATURE (1)..(1): X = s or N or T
  MISC_FEATURE (1)..(1): X = S or N or T
  MISC_FEATURE (2)..(2): X = Y or H
  MISC_FEATURE (3)..(3): X = A or P or V
XXXMS

SEQ ID NO: 50044 - protein, 17 aa, Artificial
  Synthetic
  MISC_FEATURE (1)..(1): X = V or A or I
  MISC_FEATURE (5)..(5): X = G or S
  MISC_FEATURE (7)..(7): X = S or G or T
  MISC_FEATURE (8)..(8): X = S or T
  MISC_FEATURE (9)..(9): X = T or A
XISGXGXXXYYADSVKG

SEQ ID NO: 50045 - protein, 14 aa, Artificial
  Synthetic
  MISC_FEATURE (1)..(1): X = W or A
  MISC_FEATURE (2)..(2): X = R or G
  MISC_FEATURE (4)..(4): X = N or T
  MISC_FEATURE (5)..(5): X = P or T
  MISC_FEATURE (6)..(6): X = T or G
  MISC_FEATURE (7)..(7): X = Absent or S
  MISC_FEATURE (8)..(8): X = Absent or Y
  MISC_FEATURE (9)..(9): X = Absent or Y
  MISC_FEATURE (10)..(10): X = D or Y
  MISC_FEATURE (11)..(11): X = Y or N or S
XXGXXXXXXXXGMD

SEQ ID NO: 50046 - protein, 7 aa, Artificial
  Synthetic
  MISC_FEATURE (1)..(1): X = R or G
  MISC_FEATURE (3)..(3): X = S or N
  MISC_FEATURE (4)..(4): X = Y or S
XSXXYWG

SEQ ID NO: 50047 - protein, 16 aa, Artificial
  Synthetic
  MISC_FEATURE (1)..(1): X = N or S
  MISC_FEATURE (7)..(7): X = S or Y or A or T or I
  MISC_FEATURE (8)..(8): X = T or A or P or S
  MISC_FEATURE (9)..(9): X = Y or Q or S or A or N
  MISC_FEATURE (10)..(10): X = Y or C or H
  MISC_FEATURE (11)..(11): X = N or I or T
XIYYSGXXXXXPSLKS

SEQ ID NO: 50048 - protein, 9 aa, Artificial
  Synthetic
  MISC_FEATURE (1)..(1): X = H or L
  MISC_FEATURE (3)..(3): X = S or T or G
  MISC_FEATURE (7)..(7): X = L or F or I or V
  MISC_FEATURE (9)..(9): X = Y or N or C or D or F
XSXSWSXDX

SEQ ID NO: 50049 - protein, 5 aa, Artificial
  Synthetic
  MISC_FEATURE (1)..(1): X = G or D
  MISC_FEATURE (2)..(2): X = Y or H
  MISC_FEATURE (3)..(3): X = Y or F
  MISC_FEATURE (4)..(4): X = I or M
  MISC_FEATURE (5)..(5): X = H or N
XXXXX

SEQ ID NO: 50050 - protein, 17 aa, Artificial
  Synthetic
  MISC_FEATURE (4)..(4): X = P or S
  MISC_FEATURE (5)..(5): X = N or K
  MISC_FEATURE (6)..(6): X = S or N
  MISC_FEATURE (7)..(7): X = G or D
  MISC_FEATURE (8)..(8): X = G or D
  MISC_FEATURE (12)..(12): X = A or E
  MISC_FEATURE (13)..(13): X = Q or E
  MISC_FEATURE (17)..(17): X = G or D
WINXXXXXTNYXXKFQX

SEQ ID NO: 50051 - protein, 15 aa, Artificial
  Synthetic
  MISC_FEATURE (1)..(1): X = G or D
  MISC_FEATURE (2)..(2): X = Y or G or T or F
  MISC_FEATURE (3)..(3): X = S or Y or D or R
  MISC_FEATURE (4)..(4): X = Y or S
  MISC_FEATURE (5)..(5): X = G or Absent or S
  MISC_FEATURE (6)..(6): X = Y or S or Absent
  MISC_FEATURE (7)..(7): X = Absent or G
  MISC_FEATURE (8)..(8): X = Absent or S
  MISC_FEATURE (9)..(9): X = Absent or Y
  MISC_FEATURE (10)..(10): X = Absent or Y or F or H
  MISC_FEATURE (11)..(11): X = N or Absent or D
  MISC_FEATURE (12)..(12): X = W or Absent or D or E
  MISC_FEATURE (13)..(13): X = F or L
  MISC_FEATURE (14)..(14): X = D or A
  MISC_FEATURE (15)..(15): X = P or S
XXXXXXXXXXXXXXX

SEQ ID NO: 50052 - protein, 5 aa, Artificial
  Synthetic
  MISC_FEATURE (1)..(1): X = H or N
  MISC_FEATURE (2)..(2): X = Y or S
XXGMH

SEQ ID NO: 50053 - protein, 17 aa, Artificial
  Synthetic
  MISC_FEATURE (1)..(1): X = V or I
  MISC_FEATURE (3)..(3): X = W or Y
  MISC_FEATURE (8)..(8): X = N or Y
  MISC_FEATURE (9)..(9): X = K or E
  MISC_FEATURE (10)..(10): X = Y or C or N
XIXYDGSXXXYADSVKG

SEQ ID NO: 50054 - protein, 18 aa, Artificial
  Synthetic
  MISC_FEATURE (1)..(1): X = G or D
  MISC_FEATURE (2)..(2): X = D or R
  MISC_FEATURE (3)..(3): X = W or H
  MISC_FEATURE (4)..(4): X = N or Y
  MISC_FEATURE (5)..(5): X = P or D
  MISC_FEATURE (6)..(6): X = Absent or F
  MISC_FEATURE (7)..(7): X = Absent or H
  MISC_FEATURE (8)..(8): X = Absent or V
  MISC_FEATURE (9)..(9): X = Absent or P
  MISC_FEATURE (10)..(10): X = Absent or Y
  MISC_FEATURE (11)..(11): X = Absent or Y
  MISC_FEATURE (12)..(12): X = Absent or Y
  MISC_FEATURE (13)..(13): X = Absent or Y
  MISC_FEATURE (14)..(14): X = E or Y
  MISC_FEATURE (16)..(16): X = M or L
XXXXXXXXXXXXXXGXDV

SEQ ID NO: 50055 - protein, 5 aa, Artificial
  Synthetic
  MISC_FEATURE (2)..(2): X = Y or S
  MISC_FEATURE (5)..(5): X = S or T or N
SXAMX

SEQ ID NO: 50056 - protein, 17 aa, Artificial
  Synthetic
  MISC_FEATURE (1)..(1): X = A or V
  MISC_FEATURE (3)..(3): X = S or I
  MISC_FEATURE (5)..(5): X = S or R or N or F
  MISC_FEATURE (7)..(7): X = G or S
  MISC_FEATURE (8)..(8): X = N or R or S
  MISC_FEATURE (9)..(9): X = T or A
  MISC_FEATURE (10)..(10): X = F or Y
XIXGXGXXXXYADSVKG

SEQ ID NO: 50057 - protein, 15 aa, Artificial
  Synthetic
  MISC_FEATURE (1)..(1): X = K or D or R
  MISC_FEATURE (2)..(2): X = D or Y or H or M or R
  MISC_FEATURE (3)..(3): X = Y or G or N
  MISC_FEATURE (4)..(4): X = D or I or R or Y
  MISC_FEATURE (5)..(5): X = Y or Absent or S or V
  MISC_FEATURE (6)..(6): X = V or Absent or G or R or S
  MISC_FEATURE (7)..(7): X = W or Absent or I
  MISC_FEATURE (8)..(8): X = Absent or A
  MISC_FEATURE (9)..(9): X = G or Absent or V
  MISC_FEATURE (10)..(10): X = S or Absent or A or T or Y
  MISC_FEATURE (11)..(11): X = P or Absent or G or I
  MISC_FEATURE (12)..(12): X = Y or F or T
XXXXXXXXXXXXFDY

SEQ ID NO: 50058 - protein, 5 aa, Artificial
  Synthetic
  MISC_FEATURE (1)..(1): X = G or D
  MISC_FEATURE (2)..(2): X = Y or H
  MISC_FEATURE (3)..(3): X = Y or C
  MISC_FEATURE (4)..(4): X = M or I
XXXXH

SEQ ID NO: 50059 - protein, 17 aa, Artificial
  Synthetic
  MISC_FEATURE (1)..(1): X = W or S
  MISC_FEATURE (3)..(3): X = N or Y
  MISC_FEATURE (4)..(4): X = P or R
  MISC_FEATURE (5)..(5): X = N or K
  MISC_FEATURE (8)..(8): X = G or A
  MISC_FEATURE (9)..(9): X = T or A
  MISC_FEATURE (10)..(10): X = N or D
  MISC_FEATURE (11)..(11): X = Y or N or S
  MISC_FEATURE (12)..(12): X = A or G or V
  MISC_FEATURE (17)..(17): X = G or D or V
XIXXXSGXXXXXQKFQX

SEQ ID NO: 50060 - protein, 15 aa, Artificial
  Synthetic
  MISC_FEATURE (1)..(1): X = S or A or V or T
  MISC_FEATURE (2)..(2): X = Y or F or N
  MISC_FEATURE (4)..(4): X = Y or H
  MISC_FEATURE (8)..(8): X = S or T
  MISC_FEATURE (10)..(10): X = Y or H
  MISC_FEATURE (12)..(12): X = E or G or D
XXYXGSGXYXNXFDY

SEQ ID NO: 50061 - protein, 5 aa, Artificial
  Synthetic
  MISC_FEATURE (4)..(4): X = I or T
GYYXH

SEQ ID NO: 50062 - protein, 17 aa, Artificial
  Synthetic
  MISC_FEATURE (8)..(8): X = D or G
  MISC_FEATURE (10)..(10): X = N or K
  MISC_FEATURE (11)..(11): X = Y or S
WINPYSGXTXXAQKFQG

SEQ ID NO: 50063 - protein, 5 aa, Artificial
  Synthetic
  MISC_FEATURE (1)..(1): X = S or T
  MISC_FEATURE (2)..(2): X = Y or F
  MISC_FEATURE (3)..(3): X = S or T or N or G
  MISC_FEATURE (5)..(5): X = N or S or I
XXXMX

SEQ ID NO: 50064 - protein, 17 aa, Artificial
  Synthetic
  MISC_FEATURE (4)..(4): X = G or S
  MISC_FEATURE (5)..(5): X = S or T
  MISC_FEATURE (6)..(6): X = S or I or N
  MISC_FEATURE (7)..(7): X = S or N or T or Y
  MISC_FEATURE (9)..(9): X = I or M or S
  MISC_FEATURE (10)..(10): X = Y or N
  MISC_FEATURE (12)..(12): X = A or T
SISXXXXYXXYXDSVKG

SEQ ID NO: 50065 - protein, 5 aa, Artificial
  Synthetic
LTFDY

SEQ ID NO: 50066 - protein, 5 aa, Artificial
  Synthetic
  MISC_FEATURE (1)..(1): X = T or S
XYGMH

SEQ ID NO: 50067 - protein, 17 aa, Artificial
  Synthetic
  MISC_FEATURE (1)..(1): X = I or V
  MISC_FEATURE (7)..(7): X = T or S
  MISC_FEATURE (16)..(16): X = K or R
XIWYDGXNKYYADSVXG

SEQ ID NO: 50068 - protein, 13 aa, Artificial
  Synthetic
  MISC_FEATURE (11)..(11): X = M or L
DPLRGYNDPVXDY

SEQ ID NO: 50069 - protein, 5 aa, Artificial
  Synthetic
  MISC_FEATURE (1)..(1): X = S or N
  MISC_FEATURE (5)..(5): X = S or N or T
XYAMX

SEQ ID NO: 50070 - protein, 17 aa, Artificial
  Synthetic
  MISC_FEATURE (5)..(5): X = R or S
  MISC_FEATURE (7)..(7): X = G or K
AISGXGXNTFYADSVKG

SEQ ID NO: 50071 - protein, 13 aa, Artificial
  Synthetic
RVTDYGGNDWFDP

SEQ ID NO: 50072 - protein, 5 aa, Artificial
  Synthetic
  MISC_FEATURE (1)..(1): X = T or S
XYGMH

SEQ ID NO: 50073 - protein, 17 aa, Artificial
  Synthetic
  MISC_FEATURE (2)..(2): X = I or V
  MISC_FEATURE (5)..(5): X = G or D
  MISC_FEATURE (7)..(7): X = S or N
  MISC_FEATURE (8)..(8): X = N or D or S
  MISC_FEATURE (9)..(9): X = K or T
  MISC_FEATURE (10)..(10): X = D or Y or S
  MISC_FEATURE (11)..(11): X = Y or F
  MISC_FEATURE (12)..(12): X = A or V
  MISC_FEATURE (16)..(16): X = K or R or T
VXWYXGXXXXXXDSVXG

SEQ ID NO: 50074 - protein, 20 aa, Artificial
  Synthetic
  MISC_FEATURE (3)..(3): X = D or V
  MISC_FEATURE (4)..(4): X = Y or F
  MISC_FEATURE (8)..(8): X = G or T
  MISC_FEATURE (9)..(9): X = S or T or N
DRXXCSGXXCPYYYYYGMDV

SEQ ID NO: 50075 - protein, 7 aa, Artificial
  Synthetic
RSSYYWG

SEQ ID NO: 50076 - protein, 16 aa, Artificial
  Synthetic
  MISC_FEATURE (5)..(5): X = S or G
  MISC_FEATURE (7)..(7): X = S or T or N
  MISC_FEATURE (8)..(8): X = T or A
  MISC_FEATURE (10)..(10): X = Y or N or D or H or T
  MISC_FEATURE (14)..(14): X = L or V
  MISC_FEATURE (16)..(16): X = S or G
NIYYXGXXYXNPSXKX

SEQ ID NO: 50077 - protein, 9 aa, Artificial
  Synthetic
  MISC_FEATURE (9)..(9): X = Y or F or N
HGKDWGLDX

SEQ ID NO: 50078 - protein, 5 aa, Artificial
  Synthetic
  MISC_FEATURE (4)..(4): X = M or I
GYYXH

SEQ ID NO: 50079 - protein, 17 aa, Artificial
  Synthetic
  MISC_FEATURE (3)..(3): X = K or N
  MISC_FEATURE (5)..(5): X = N or K
  MISC_FEATURE (11)..(11): X = Q or S or H or N or Y
  MISC_FEATURE (12)..(12): A or V
  MISC_FEATURE (12)..(12): X = A or V
WIXPXSGGTNXXQKFQG

SEQ ID NO: 50080 - protein, 15 aa, Artificial
  Synthetic
  MISC_FEATURE (4)..(4): X = T or K or I
  MISC_FEATURE (5)..(5): X = A or V
  MISC_FEATURE (6)..(6): X = A or P
  MISC_FEATURE (7)..(7): X = A or T
  MISC_FEATURE (9)..(9): X = T or S
  MISC_FEATURE (12)..(12): X = Y or F or C
APGXXXXGXWGXFDY

SEQ ID NO: 50081 - protein, 7 aa, Artificial
  Synthetic
  MISC_FEATURE (2)..(2): X = G or S
TXGVGVG

SEQ ID NO: 50082 - protein, 16 aa, Artificial
  Synthetic
  MISC_FEATURE (1)..(1): X = L or F
  MISC_FEATURE (5)..(5): X = D or H or N or K or S
  MISC_FEATURE (8)..(8): X = K or E
  MISC_FEATURE (15)..(15): X = K or R
XIYWXDDXRYSPSLXS

SEQ ID NO: 50083 - protein, 8 aa, Artificial
  Synthetic
  MISC_FEATURE (1)..(1): X - L or I or A
  MISC_FEATURE (1)..(1): X = L or I or A
  MISC_FEATURE (2)..(2): X = I or V or A
  MISC_FEATURE (5)..(5): X = A or S
  MISC_FEATURE (6)..(6): X = F or C
XXAVXXDY

SEQ ID NO: 50084 - protein, 5 aa, Artificial
  Synthetic
  MISC_FEATURE (1)..(1): X = S or N or T
XYGMH

SEQ ID NO: 50085 - protein, 17 aa, Artificial
  Synthetic
  MISC_FEATURE (1)..(1): X = I or V
  MISC_FEATURE (8)..(8): X = Y or N
  MISC_FEATURE (12)..(12): X = A or V
XIWYDGSXKYYXDSVKG

SEQ ID NO: 50086 - protein, 12 aa, Artificial
  Synthetic
  MISC_FEATURE (2)..(2): X = A or G or R or N
  MISC_FEATURE (9)..(9): X = Y or F or H
  MISC_FEATURE (10)..(10): X = F or L or Y or W
  MISC_FEATURE (11)..(11): X = D or G
  MISC_FEATURE (12)..(12): X = Y or S
EXYDFWSGXXXX

SEQ ID NO: 50087 - protein, 5 aa, Artificial
  Synthetic
  MISC_FEATURE (4)..(4): X = M or L
SYGXH

SEQ ID NO: 50088 - protein, 17 aa, Artificial
  Synthetic
  MISC_FEATURE (10)..(10): X = Y or N
  MISC_FEATURE (12)..(12): X = A or E
VIWYDGSNKXYXDSVKG

SEQ ID NO: 50089 - protein, 17 aa, Artificial
  Synthetic
  MISC_FEATURE (1)..(1): X = D or W
  MISC_FEATURE (2)..(2): X = R or G or Y
  MISC_FEATURE (3)..(3): X = D or S or Y
  MISC_FEATURE (5)..(5): X = G or Y
  MISC_FEATURE (6)..(6): X = D or Y
  MISC_FEATURE (7)..(7): X = Absent or P
  MISC_FEATURE (8)..(8): X = Absent or P
  MISC_FEATURE (9)..(9): X = Absent or Y
  MISC_FEATURE (10)..(10): X = Absent or Y
  MISC_FEATURE (11)..(11): X = Absent or Y
  MISC_FEATURE (12)..(12): X = Absent or Y
  MISC_FEATURE (13)..(13): X = Y or D
XXXYXXXXXXXXXGMDV

SEQ ID NO: 50090 - protein, 5 aa, Artificial
  Synthetic
  MISC_FEATURE (1)..(1): X = S or N or T
  MISC_FEATURE (2)..(2): X = Y or S
  MISC_FEATURE (3)..(3): X = A or V
  MISC_FEATURE (5)..(5): X = S or T or N
XXXMX

SEQ ID NO: 50091 - protein, 17 aa, Artificial
  Synthetic
  MISC_FEATURE (1)..(1): X = A or G
  MISC_FEATURE (2)..(2): X = I or S or V
  MISC_FEATURE (3)..(3): X = S or V
  MISC_FEATURE (5)..(5): X = S or R
  MISC_FEATURE (7)..(7): X = G or A or S or V
  MISC_FEATURE (8)..(8): X = N or R or K
  MISC_FEATURE (10)..(10): X = F or Y
  MISC_FEATURE (11)..(11): X = Y or N
  MISC_FEATURE (12)..(12): X = A or T
  MISC_FEATURE (16)..(16): X = K or T
XXXGXGXXTXXXDSVXG

SEQ ID NO: 50092 - protein, 12 aa, Artificial
  Synthetic
  MISC_FEATURE (1)..(1): X = L or D or E
  MISC_FEATURE (2)..(2): X = G or R
  MISC_FEATURE (3)..(3): X = K or G or I
  MISC_FEATURE (4)..(4): X = D or Q or Y
  MISC_FEATURE (5)..(5): X = Y or W
  MISC_FEATURE (6)..(6): X = Y or H or L
  MISC_FEATURE (7)..(7): X = Y or Absent or I or L
  MISC_FEATURE (8)..(8): X = Y or G
  MISC_FEATURE (10)..(10): X = M or V
XXXXXXXXGXDV

SEQ ID NO: 50093 - protein, 5 aa, Artificial
  Synthetic
  MISC_FEATURE (3)..(3): X = V or A
  MISC_FEATURE (5)..(5): X = S or N
SYXMX

SEQ ID NO: 50094 - protein, 17 aa, Artificial
  Synthetic
  MISC_FEATURE (1)..(1): X = A or G or T or S
  MISC_FEATURE (2)..(2): X = M or I or T
  MISC_FEATURE (7)..(7): X = G or N or V
  MISC_FEATURE (8)..(8): X = R or N or W
  MISC_FEATURE (10)..(10): X = Y or F or N
  MISC_FEATURE (16)..(16): X = K or N
  MISC_FEATURE (17)..(17): X = G or D
XXSGSGXXTXYADSVXX

SEQ ID NO: 50095 - protein, 12 aa, Artificial
  Synthetic
  MISC_FEATURE (1)..(1): X = L or V or Y or F
  MISC_FEATURE (2)..(2): X = T or E or F or G
  MISC_FEATURE (3)..(3): X = A or G or L or W or Absent or F
  MISC_FEATURE (4)..(4): X = Absent or G or M
  MISC_FEATURE (5)..(5): X = Absent or V
  MISC_FEATURE (6)..(6): X = Absent or G
  MISC_FEATURE (7)..(7): X = Absent or A
  MISC_FEATURE (8)..(8): X = Absent or G
  MISC_FEATURE (9)..(9): X = Absent or I or F
  MISC_FEATURE (10)..(10): X = F or N or Absent
  MISC_FEATURE (11)..(11): X = D or G or I
  MISC_FEATURE (12)..(12): X = Y or D
XXXXXXXXXXXX

SEQ ID NO: 50096 - protein, 5 aa, Artificial
  Synthetic
  MISC_FEATURE (1)..(1): X = S or Y
  MISC_FEATURE (4)..(4): X = M or L
XYGXH

SEQ ID NO: 50097 - protein, 17 aa, Artificial
  Synthetic
  MISC_FEATURE (1)..(1): X = I or V
  MISC_FEATURE (5)..(5): X = A or G or D or S or V
  MISC_FEATURE (7)..(7): X = S or I or N or R or T
  MISC_FEATURE (9)..(9): X = K or N or Q
  MISC_FEATURE (10)..(10): X = Y or S or D or H
  MISC_FEATURE (11)..(11): X = Y or S
XISYXGXNXXXADSVKG

SEQ ID NO: 50098 - protein, 20 aa, Artificial
  Synthetic
  MISC_FEATURE (1)..(1): X = R or E
  MISC_FEATURE (2)..(2): X = G or D
  MISC_FEATURE (3)..(3): X = Y or R
  MISC_FEATURE (4)..(4): X = S or Y
  MISC_FEATURE (5)..(5): X = Y or C
  MISC_FEATURE (6)..(6): X = G or S
  MISC_FEATURE (7)..(7): X = Absent or G
  MISC_FEATURE (8)..(8): X = Absent or T
  MISC_FEATURE (9)..(9): X = Absent or S
  MISC_FEATURE (10)..(10): X = Absent or C
  MISC_FEATURE (11)..(11): X = Absent or P
  MISC_FEATURE (12)..(12): X = Absent or Y
  MISC_FEATURE (13)..(13): X = Absent or Y
  MISC_FEATURE (14)..(14): X = Absent or Y
  MISC_FEATURE (15)..(15): X = G or Y
XXXXXXXXXXXXXXXYGMDV

SEQ ID NO: 50099 - protein, 5 aa, Artificial
  Synthetic
  MISC_FEATURE (1)..(1): X = D or S
  MISC_FEATURE (2)..(2): X = Y or C
  MISC_FEATURE (3)..(3): X = V or G
  MISC_FEATURE (5)..(5): X = H or Q
XXXMX

SEQ ID NO: 50100 - protein, 17 aa, Artificial
  Synthetic
  MISC_FEATURE (1)..(1): X = V or I
  MISC_FEATURE (17)..(17): X = G or V
XIWYDGSNKYYADSVKX

SEQ ID NO: 50101 - protein, 14 aa, Artificial
  Synthetic
  MISC_FEATURE (2)..(2): X = P or R
  MISC_FEATURE (4)..(4): X = T or N
  MISC_FEATURE (8)..(8): X = Y or H
  MISC_FEATURE (12)..(12): X = M or L
EXYXSGWXDYGXDV

SEQ ID NO: 50102 - protein, 5 aa, Artificial
  Synthetic
  MISC_FEATURE (4)..(4): X = I or F or V
SYGXS

SEQ ID NO: 50103 - protein, 17 aa, Artificial
  Synthetic
  MISC_FEATURE (9)..(9): X = T or R
  MISC_FEATURE (11)..(11): X = Y or N or E or F
  MISC_FEATURE (14)..(14): X = K or R
  MISC_FEATURE (15)..(15): X = L or F
WISAYNGNXKXAQXXQG

SEQ ID NO: 50104 - protein, 5 aa, Artificial
  Synthetic
  MISC_FEATURE (1)..(1): X = S or R
  MOD_RES (2)..(2): Any amino acid
  MISC_FEATURE (3)..(3): X = Y or S
XXAMS

SEQ ID NO: 50105 - protein, 17 aa, Artificial
  Synthetic
  MISC_FEATURE (1)..(1): X = A or V or S
  MISC_FEATURE (5)..(5): X = R or S
  MISC_FEATURE (7)..(7): X = G or I or V
  MISC_FEATURE (8)..(8): X = N or S
  MISC_FEATURE (11)..(11): X = D or Y
  MISC_FEATURE (12)..(12): X = A or T
XISGXGXXTFXXDSVKG

SEQ ID NO: 50106 - protein, 9 aa, Artificial
  Synthetic
  MISC_FEATURE (1)..(1): X = E or S
  MISC_FEATURE (2)..(2): X = R or N
  MISC_FEATURE (4)..(4): X = G or S
  MISC_FEATURE (5)..(5): X = S or G
  MISC_FEATURE (6)..(6): X = Y or W
XXSXXXFDY

SEQ ID NO: 50107 - protein, 5 aa, Artificial
  Synthetic
  MISC_FEATURE (1)..(1): X = S or N or Y or H
  MISC_FEATURE (3)..(3): X = V or G
XYXMH

SEQ ID NO: 50108 - protein, 17 aa, Artificial
  Synthetic
  MISC_FEATURE (1)..(1): X = V or L
  MISC_FEATURE (4)..(4): X = H or Y
  MISC_FEATURE (7)..(7): X = S or T
  MISC_FEATURE (8)..(8): X = N or D
  MISC_FEATURE (9)..(9): X = K or A
  MISC_FEATURE (12)..(12): X = A or V or G
XIWXDGXXXYYXDSVKG

SEQ ID NO: 50109 - protein, 21 aa, Artificial
  Synthetic
  MISC_FEATURE (6)..(6): X = Y or F
ENSSSXYFDYWGQGTLVTVSS

SEQ ID NO: 50110 - protein, 7 aa, Artificial
  Synthetic
TSGVGVG

SEQ ID NO: 50111 - protein, 16 aa, Artificial
  Synthetic
  MISC_FEATURE (10)..(10): X = Y or F
LINWNDDKRXSPSLKS

SEQ ID NO: 50112 - protein, 9 aa, Artificial
  Synthetic
  MISC_FEATURE (2)..(2): X = A or T
KXTWVAFDI

SEQ ID NO: 50113 - protein, 5 aa, Artificial
  Synthetic
  MISC_FEATURE (3)..(3): X = V or A
  MISC_FEATURE (4)..(4): X = M or I or L
  MISC_FEATURE (5)..(5): X = N or S or R
SYXXX

SEQ ID NO: 50114 - protein, 17 aa, Artificial
  Synthetic
  MISC_FEATURE (1)..(1): X = A or D
  MISC_FEATURE (2)..(2): X = I or M
  MISC_FEATURE (7)..(7): X = G or D or V
  MISC_FEATURE (8)..(8): X = R or S or F or T
  MISC_FEATURE (12)..(12): X = A or V
XXSGSGXXTYYXDSVKG

SEQ ID NO: 50115 - protein, 6 aa, Artificial
  Synthetic
  MISC_FEATURE (2)..(2): X = A or G or S or T or Y
  MISC_FEATURE (3)..(3): X = T or V or Absent or H or L or G
  MISC_FEATURE (4)..(4): X = F or Absent or K
  MISC_FEATURE (5)..(5): X = D or Absent
  MISC_FEATURE (6)..(6): X = Y or L
TXXXXX

SEQ ID NO: 50116 - protein, 5 aa, Artificial
  Synthetic
  MISC_FEATURE (2)..(2): X = Y or F
  MISC_FEATURE (5)..(5): X = S or N
SXAMX

SEQ ID NO: 50117 - protein, 17 aa, Artificial
  Synthetic
  MISC_FEATURE (1)..(1): X = V or A or I
  MISC_FEATURE (2)..(2): X = I or L
  MISC_FEATURE (5)..(5): X = R or S or G
  MISC_FEATURE (7)..(7): X = G or S or K
  MISC_FEATURE (8)..(8): X = T or N or S
  MISC_FEATURE (10)..(10): X = F or Y
XXSGXGXXTXYADSVKG

SEQ ID NO: 50118 - protein, 10 aa, Artificial
  Synthetic
  MISC_FEATURE (4)..(4): X = P or G
  MISC_FEATURE (5)..(5): X = S or D or E
  MISC_FEATURE (7)..(7): X = V or A
  MISC_FEATURE (10)..(10): X =  I or V
  MISC_FEATURE (10)..(10): X = I or V
KRTXXDXFDX

SEQ ID NO: 50119 - protein, 7 aa, Artificial
  Synthetic
SGGDYWS

SEQ ID NO: 50120 - protein, 16 aa, Artificial
  Synthetic
  MISC_FEATURE (7)..(7): X = S or I or P
YIYYSGXTYYNPSLKS

SEQ ID NO: 50121 - protein, 9 aa, Artificial
  Synthetic
  MISC_FEATURE (2)..(2): X = S or G or H
  MISC_FEATURE (3)..(3): X = S or A
  MISC_FEATURE (4)..(4): X = S or L or R
  MISC_FEATURE (5)..(5): X = Y or R or H
DXXXXGMDV

SEQ ID NO: 50122 - protein, 11 aa, Artificial
  Synthetic
  MISC_FEATURE (1)..(1): X = R or L
  MISC_FEATURE (2)..(2): X = A or T
  MISC_FEATURE (4)..(4): X = Q or R
  MISC_FEATURE (5)..(5): X = G or D or A or V
  MISC_FEATURE (6)..(6): X = I or M or V
  MISC_FEATURE (7)..(7): X = R or E or K or N or S
  MISC_FEATURE (8)..(8): X = N or S or D or T or K or I
  MISC_FEATURE (9)..(9): X = D or N or A
  MISC_FEATURE (10)..(10): X = L or F or V
  MISC_FEATURE (11)..(11): X = G or D or N
XXSXXXXXXXX

SEQ ID NO: 50123 - protein, 7 aa, Artificial
  Synthetic
  MISC_FEATURE (1)..(1): X = A or T or S or V or G or D or R
  MISC_FEATURE (2)..(2): X = A or T or V or E
  MISC_FEATURE (3)..(3): X = S or F or C or Y
  MISC_FEATURE (4)..(4): X = S or N or T or F or R or I
  MISC_FEATURE (5)..(5): X = L or V or F or S
  MISC_FEATURE (6)..(6): X = Q or H or E
  MISC_FEATURE (7)..(7): X = S or R or N or T or G
XXXXXXX

SEQ ID NO: 50124 - protein, 9 aa, Artificial
  Synthetic
  MISC_FEATURE (1)..(1): X = L or V or I
  MISC_FEATURE (2)..(2): X = Q or H
  MISC_FEATURE (3)..(3): X = H or D or Y or N or R
  MISC_FEATURE (4)..(4): X = N or S or Y or T or D or K or A or I or E or H or P or R
  MISC_FEATURE (5)..(5): X = S or I or N or R or T or D or A or L or V
  MISC_FEATURE (6)..(6): X = Y or F or H or S
  MISC_FEATURE (7)..(7): X = P or A or M
  MISC_FEATURE (8)..(8): X = L or P or F or N or V
  MISC_FEATURE (9)..(9): X = T or K or I
XXXXXXXXX

SEQ ID NO: 50125 - protein, 11 aa, Artificial
  Synthetic
  MISC_FEATURE (3)..(3): X = D or N or E or Y or S
  MISC_FEATURE (4)..(4): X = K or R or N or E or T
  MISC_FEATURE (5)..(5): X = L or M or S
  MISC_FEATURE (7)..(7): X = D or N or E or G or Y or T or H or V
  MISC_FEATURE (8)..(8): X = K or R
  MISC_FEATURE (9)..(9): X = Y or F or S
  MISC_FEATURE (10)..(10): X = A or V or T or D or S
  MISC_FEATURE (11)..(11): X = C or S or Y or W or H
SGXXXGXXXXX

SEQ ID NO: 50126 - protein, 7 aa, Artificial
  Synthetic
  MISC_FEATURE (1)..(1): X = Q or E or K
  MISC_FEATURE (2)..(2): X = D or N
  MISC_FEATURE (3)..(3): X = R or S or N or K or Y or M or T or G or I
  MISC_FEATURE (4)..(4): X = K or R or Q
  MISC_FEATURE (6)..(6): X = P or S
  MISC_FEATURE (7)..(7): X = S or L
XXXXRXX

SEQ ID NO: 50127 - protein, 12 aa, Artificial
  Synthetic
  MISC_FEATURE (1)..(1): X = R or W
  MISC_FEATURE (2)..(2): X = A or T
  MISC_FEATURE (3)..(3): X = S or G or R
  MISC_FEATURE (4)..(4): X = Q or P
  MISC_FEATURE (5)..(5): X = S or N or I or R
  MISC_FEATURE (6)..(6): X = V or I or F
  MISC_FEATURE (7)..(7): X = Y or R or S or N or D or F or H or G or W
  MISC_FEATURE (8)..(8): X = S or T or N or G or L or R
  MISC_FEATURE (9)..(9): X = S or N or G or R or D or A or Y
  MISC_FEATURE (10)..(10): X = Y or F or H
  MISC_FEATURE (12)..(12): X = A or V or S
XXXXXXXXXXLX

SEQ ID NO: 50128 - protein, 7 aa, Artificial
  Synthetic
  MISC_FEATURE (1)..(1): X = G or D or V
  MISC_FEATURE (2)..(2): X = A or T or P or V
  MISC_FEATURE (3)..(3): X = S or F or Y or A or T
  MISC_FEATURE (4)..(4): X = S or R or N or A
  MISC_FEATURE (6)..(6): X = A or S or T
  MISC_FEATURE (7)..(7): X = T or P or S or A
XXXXRXX

SEQ ID NO: 50129 - protein, 10 aa, Artificial
  Synthetic
  MISC_FEATURE (1)..(1): X = Q or H
  MISC_FEATURE (2)..(2): X = Q or H
  MISC_FEATURE (3)..(3): X = Y or S
  MISC_FEATURE (4)..(4): X = D or E or G or H
  MISC_FEATURE (5)..(5): X = N or S or Absent or R or T or I or D or G
  MISC_FEATURE (6)..(6): X = Absent or S
  MISC_FEATURE (7)..(7): X = S or P or N or R
  MISC_FEATURE (8)..(8): X = P or S or V
  MISC_FEATURE (9)..(9): X = W or R
  MISC_FEATURE (10)..(10): X = T or A
XXXXXXXXXX

SEQ ID NO: 50130 - protein, 11 aa, Artificial
  Synthetic
  MISC_FEATURE (2)..(2): X = A or T
  MISC_FEATURE (3)..(3): X = S or T
  MISC_FEATURE (4)..(4): X = Q or R
  MISC_FEATURE (5)..(5): X = G or D or A or N or V
  MISC_FEATURE (7)..(7): X = R or G
  MISC_FEATURE (8)..(8): X = N or K or D or H or S or G or T
  MISC_FEATURE (9)..(9): X = D or I or Y
  MISC_FEATURE (11)..(11): X = G or N
RXXXXIXXXLX

SEQ ID NO: 50131 - protein, 7 aa, Artificial
  Synthetic
  MISC_FEATURE (1)..(1): X = A or T or I or V or P or G or R or S
  MISC_FEATURE (2)..(2): X = A or T or S
  MISC_FEATURE (3)..(3): X = S or A or F or P or Y
  MISC_FEATURE (4)..(4): X = S or N or R or G or T
  MISC_FEATURE (5)..(5): X = L or C or F or S
  MISC_FEATURE (6)..(6): X = Q or H or E
  MISC_FEATURE (7)..(7): X = S or N or G or I
XXXXXXX

SEQ ID NO: 50132 - protein, 10 aa, Artificial
  Synthetic
  MISC_FEATURE (1)..(1): X = L or V or I or H
  MISC_FEATURE (2)..(2): X = Q or M or H or L or V
  MISC_FEATURE (3)..(3): X = H or Q or Y or L or S
  MISC_FEATURE (4)..(4): X = Y or N or H or S or T
  MISC_FEATURE (5)..(5): X = S or N or T or R or D or F or G
  MISC_FEATURE (6)..(6): X = Absent or Y or F
  MISC_FEATURE (7)..(7): X = Y or F or P or C or N or T
  MISC_FEATURE (8)..(8): X = P or L
  MISC_FEATURE (9)..(9): X = R or W or F or L
XXXXXXXXXT

SEQ ID NO: 50133 - protein, 17 aa, Artificial
  Synthetic
  MISC_FEATURE (1)..(1): X = K or R or M
  MISC_FEATURE (2)..(2): X = S or G or R
  MISC_FEATURE (3)..(3): X = S or T or N or I
  MISC_FEATURE (6)..(6): X = V or I or A
  MISC_FEATURE (8)..(8): X = H or Y or F or S or K or D or L or M
  MISC_FEATURE (9)..(9): X = S or T or R or N or I or D
  MISC_FEATURE (10)..(10): X = S or F or P
  MISC_FEATURE (11)..(11): X = N or H
  MISC_FEATURE (12)..(12): X = N or K or S or D or H
  MISC_FEATURE (13)..(13): X = N or Y or K or H or R or A or F or W
  MISC_FEATURE (14)..(14): X = N or H or Y
  MISC_FEATURE (15)..(15): X = Y or S
  MISC_FEATURE (16)..(16): X = L or F
  MISC_FEATURE (17)..(17): X = A or T or V or G
XXXQSXLXXXXXXXXXX

SEQ ID NO: 50134 - protein, 9 aa, Artificial
  Synthetic
  MISC_FEATURE (1)..(1): X = Q or H or L
  MISC_FEATURE (2)..(2): X = Q or H
  MISC_FEATURE (3)..(3): X = Y or F
  MISC_FEATURE (4)..(4): X = Y or F or H or N or L or S
  MISC_FEATURE (5)..(5): X = S or N or R or D or I or T or C or E or K
  MISC_FEATURE (6)..(6): X = T or S or I or V or A or Y
  MISC_FEATURE (8)..(8): X = P or W or L or V or C or G or R or S
  MISC_FEATURE (9)..(9): X = T or K or S
XXXXXXPXX

SEQ ID NO: 50135 - protein, 11 aa, Artificial
  Synthetic
  MISC_FEATURE (2)..(2): X = A or T
  MISC_FEATURE (5)..(5): X = G or D or V
  MISC_FEATURE (6)..(6): X = I or M
  MISC_FEATURE (7)..(7): X = R or S
  MISC_FEATURE (8)..(8): X = N or K or S or D or T
  MISC_FEATURE (9)..(9): X = D or N or H or Y or V or A or I or L
  MISC_FEATURE (10)..(10): X = L or F
  MISC_FEATURE (11)..(11): X = G or D
RXSQXXXXXXX

SEQ ID NO: 50136 - protein, 7 aa, Artificial
  Synthetic
  MISC_FEATURE (1)..(1): X = A or P or T or G or I or R or V
  MISC_FEATURE (2)..(2): X = A or V
  MISC_FEATURE (3)..(3): X = S or F or T
  MISC_FEATURE (4)..(4): X = S or N or T or D
  MISC_FEATURE (4)..(4): X = S or N or T or R or D
  MISC_FEATURE (5)..(5): X = L or V
  MISC_FEATURE (6)..(6): X = Q or L
  MISC_FEATURE (7)..(7): X = S or N or T or G or R
XXXXXXX

SEQ ID NO: 50137 - protein, 9 aa, Artificial
  Synthetic
  MISC_FEATURE (1)..(1): X = L or I
  MISC_FEATURE (2)..(2): X = Q or H or L
  MISC_FEATURE (3)..(3): X = H or Y or D or L
  MISC_FEATURE (4)..(4): X = N or Y or T or H or G or I
  MISC_FEATURE (5)..(5): X = S or R or D or T or G or N
  MISC_FEATURE (6)..(6): X = Y or F or H
  MISC_FEATURE (7)..(7): X = P or L
  MISC_FEATURE (8)..(8): X = F or L
  MISC_FEATURE (9)..(9): X = T or K
XXXXXXXXX

SEQ ID NO: 50138 - protein, 11 aa, Artificial
  Synthetic
  MISC_FEATURE (2)..(2): X = A or T
  MISC_FEATURE (3)..(3): X = S or N
  MISC_FEATURE (5)..(5): X = G or D or A or V or S
  MISC_FEATURE (7)..(7): X = S or G or N or R or A or F
  MISC_FEATURE (8)..(8): X = N or K or R or H or S or T or I
  MISC_FEATURE (9)..(9): X = Y or H or C or D
  MISC_FEATURE (11)..(11): X = A or D or V or I or N
RXXQXIXXXLX

SEQ ID NO: 50139 - protein, 7 aa, Artificial
  Synthetic
  MISC_FEATURE (1)..(1): X = A or K or S or T or V or D or G
  MISC_FEATURE (2)..(2): X = A or T or V
  MISC_FEATURE (3)..(3): X = S or P
  MISC_FEATURE (4)..(4): X = S or N or R
  MISC_FEATURE (6)..(6): X = Q or L or E or H
  MISC_FEATURE (7)..(7): X = S or G or N or T
XXXXLXX

SEQ ID NO: 50140 - protein, 9 aa, Artificial
  Synthetic
  MISC_FEATURE (1)..(1): X = Q or L or H
  MISC_FEATURE (2)..(2): X = Q or H or R or Y
  MISC_FEATURE (3)..(3): X = Y or S or C or T
  MISC_FEATURE (4)..(4): X = S or L or N or M or D or H or V or I or Y
  MISC_FEATURE (5)..(5): X = T or N or S or K
  MISC_FEATURE (6)..(6): X = Y or F or I or S
  MISC_FEATURE (8)..(8): X = L or V or F or N
  MISC_FEATURE (9)..(9): X = T or I or Q or S
XXXXXXPXX

SEQ ID NO: 50141 - protein, 11 aa, Artificial
  Synthetic
  MISC_FEATURE (2)..(2): X = A or T
  MISC_FEATURE (3)..(3): X = S or T
  MISC_FEATURE (4)..(4): X = Q or H or R
  MISC_FEATURE (5)..(5): X = N or S or R or T or I
  MISC_FEATURE (6)..(6): X = I or V or F
  MISC_FEATURE (7)..(7): X = I or S or N or Y or F or R or H or L or K or T
  MISC_FEATURE (8)..(8): X = S or N or D or R or K or T
  MISC_FEATURE (9)..(9): X = Y or F
  MISC_FEATURE (11)..(11): X = N or H
RXXXXXXXXLX

SEQ ID NO: 50142 - protein, 7 aa, Artificial
  Synthetic
  MISC_FEATURE (1)..(1): X = T or A or V or G or I or S
  MISC_FEATURE (2)..(2): X = A or T
  MISC_FEATURE (4)..(4): X = S or N or R or T
  MISC_FEATURE (5)..(5): X = L or F or S
  MISC_FEATURE (6)..(6): X = Q or H or E or P
  MISC_FEATURE (7)..(7): X = S or G or T or N or R
XXSXXXX

SEQ ID NO: 50143 - protein, 9 aa, Artificial
  Synthetic
  MISC_FEATURE (2)..(2): X = Q or L
  MISC_FEATURE (3)..(3): X = S or T or N or P
  MISC_FEATURE (4)..(4): X = Y or H or C or D or F or N
  MISC_FEATURE (5)..(5): X = S or Absent or I or N or F or G or T
  MISC_FEATURE (6)..(6): X = T or S or P or F or N or I or L
  MISC_FEATURE (7)..(7): X = P or T or I or A or S
  MISC_FEATURE (8)..(8): X = L or P or Y or F or V
QXXXXXXXT

SEQ ID NO: 50144 - protein, 11 aa, Artificial
  Synthetic
  MISC_FEATURE (1)..(1): X = R or P
  MISC_FEATURE (2)..(2): X = A or T
  MISC_FEATURE (3)..(3): X = S or N
  MISC_FEATURE (4)..(4): X = Q or R
  MISC_FEATURE (5)..(5): X = G or D or V or A
  MISC_FEATURE (6)..(6): X = I or V
  MISC_FEATURE (7)..(7): X = S or N or G or R or T or K
  MISC_FEATURE (8)..(8): X = N or K or Y or H or I or T
  MISC_FEATURE (9)..(9): X = Y or H
  MISC_FEATURE (11)..(11): X = A or V or S
XXXXXXXXXLX

SEQ ID NO: 50145 - protein, 7 aa, Artificial
  Synthetic
  MISC_FEATURE (1)..(1): X = A or V or G or T
  MISC_FEATURE (2)..(2): X = A or S or V
  MISC_FEATURE (3)..(3): X = S or F
  MISC_FEATURE (4)..(4): X = S or G or N or T
  MISC_FEATURE (5)..(5): X = L or V
  MISC_FEATURE (6)..(6): X = Q or R or H or L or E
  MISC_FEATURE (7)..(7): X = S or G or T
XXXXXXX

SEQ ID NO: 50146 - protein, 9 aa, Artificial
  Synthetic
  MISC_FEATURE (1)..(1): X = Q or H or L or P or R
  MISC_FEATURE (2)..(2): X = Q or R or K or H or L
  MISC_FEATURE (3)..(3): X = Y or F
  MISC_FEATURE (4)..(4): X = N or H or D or Y or S or K or L or M or Q
  MISC_FEATURE (5)..(5): X = S or T or G or N or C or D
  MISC_FEATURE (6)..(6): X = Y or F or H
  MISC_FEATURE (8)..(8): X = F or V or L or I
  MISC_FEATURE (9)..(9): X = T or K
XXXXXXPXX

SEQ ID NO: 50147 - protein, 11 aa, Artificial
  Synthetic
  MISC_FEATURE (2)..(2): X = A or V or E or G
  MISC_FEATURE (3)..(3): X = S or G
  MISC_FEATURE (4)..(4): X = Q or R
  MISC_FEATURE (5)..(5): X = G or D or N or A or L or V
  MISC_FEATURE (6)..(6): X = I or V or F
  MISC_FEATURE (7)..(7): X = S or N or T or R or I
  MISC_FEATURE (8)..(8): X = R or S or N or K or T or D or I or G
  MISC_FEATURE (9)..(9): X = W or Y
  MISC_FEATURE (10)..(10): X = L or I
  MISC_FEATURE (11)..(11): X = A or T or V
RXXXXXXXXXX

SEQ ID NO: 50148 - protein, 7 aa, Artificial
  Synthetic
  MISC_FEATURE (1)..(1): X = A or G or T or D or V
  MISC_FEATURE (2)..(2): X = A or T or V
  MISC_FEATURE (3)..(3): X = S or Y
  MISC_FEATURE (4)..(4): X = S or R or N or T or G or I
  MISC_FEATURE (5)..(5): X = L or F
  MISC_FEATURE (6)..(6): X = Q or E
  MISC_FEATURE (7)..(7): X = S or G or N or D
XXXXXXX

SEQ ID NO: 50149 - protein, 9 aa, Artificial
  Synthetic
  MISC_FEATURE (1)..(1): X = Q or H
  MISC_FEATURE (3)..(3): X = A or T or G or S or V or D
  MISC_FEATURE (4)..(4): X = N or D or K or S
  MISC_FEATURE (5)..(5): X = S or I
  MISC_FEATURE (6)..(6): X = F or L or I or V
  MISC_FEATURE (8)..(8): X = F or I
XQXXXXPXT

SEQ ID NO: 50150 - protein, 16 aa, Artificial
  Synthetic
  MISC_FEATURE (1)..(1): X = K or M or R or T
  MISC_FEATURE (3)..(3): X = S or G or T
  MISC_FEATURE (4)..(4): X = Q or K
  MISC_FEATURE (5)..(5): X = S or R or N or T
  MISC_FEATURE (7)..(7): X = L or R or V
  MISC_FEATURE (8)..(8): X = H or Y
  MISC_FEATURE (9)..(9): X = G or S
  MISC_FEATURE (10)..(10): X = D or E or G
  MISC_FEATURE (12)..(12): X = K or R
  MISC_FEATURE (14)..(14): X = Y or F
  MISC_FEATURE (15)..(15): X = L or F
  MISC_FEATURE (16)..(16): X = Y or F or T or C or S
XSXXXLXXXXGXTXXX

SEQ ID NO: 50151 - protein, 7 aa, Artificial
  Synthetic
  MISC_FEATURE (1)..(1): X = E or A
  MISC_FEATURE (2)..(2): X = V or I or L or T
  MISC_FEATURE (4)..(4): X = N or K or H or I or S
  MISC_FEATURE (6)..(6): X = F or L
  MISC_FEATURE (7)..(7): X = S or A or T or C or P
XXSXRXX

SEQ ID NO: 50152 - protein, 9 aa, Artificial
  Synthetic
  MISC_FEATURE (1)..(1): X = M or K
  MISC_FEATURE (3)..(3): X = S or T
  MISC_FEATURE (4)..(4): X = I or T or F or L
  MISC_FEATURE (5)..(5): X = Q or H
  MISC_FEATURE (6)..(6): X = L or I or V or F
  MISC_FEATURE (8)..(8): X = W or R
XQXXXXPXT

SEQ ID NO: 50153 - protein, 11 aa, Artificial
  Synthetic
  MISC_FEATURE (2)..(2): X = A or S or T
  MISC_FEATURE (3)..(3): X = S or G or I
  MISC_FEATURE (4)..(4): X = Q or H or R
  MISC_FEATURE (5)..(5): X = S or N or T
  MISC_FEATURE (6)..(6): X = I or F
  MISC_FEATURE (7)..(7): X = S or I or F or N or R or Y or T or A or G or L
  MISC_FEATURE (8)..(8): X = S or N or T or H or K
  MISC_FEATURE (9)..(9): X = Y or F or H
  MISC_FEATURE (10)..(10): X = L or V
  MISC_FEATURE (11)..(11): X = N or I or M or H or Y
RXXXXXXXXXX

SEQ ID NO: 50154 - protein, 7 aa, Artificial
  Synthetic
  MISC_FEATURE (1)..(1): X = A or G or T or V or I
  MISC_FEATURE (2)..(2): X = A or T or V or S
  MISC_FEATURE (3)..(3): X = S or F
  MISC_FEATURE (4)..(4): X = S or N or T or V
  MISC_FEATURE (6)..(6): X = Q or H
  MISC_FEATURE (7)..(7): X = S or N or G or H or I or T
XXXXLXX

SEQ ID NO: 50155 - protein, 10 aa, Artificial
  Synthetic
  MISC_FEATURE (3)..(3): x = S or T or Y
  MISC_FEATURE (3)..(3): X = S or T or Y
  MISC_FEATURE (4)..(4): X = Y or N or F or H
  MISC_FEATURE (5)..(5): X = S or R or N or F or I
  MISC_FEATURE (6)..(6): X = Absent or A or S
  MISC_FEATURE (7)..(7): X = P or T or I or F or A or L or V
  MISC_FEATURE (8)..(8): X = P or L or F or S
  MISC_FEATURE (10)..(10): X = T or A or S
QQXXXXXXFX

SEQ ID NO: 50156 - protein, 17 aa, Artificial
  Synthetic
  MISC_FEATURE (1)..(1): X = K or R or T
  MISC_FEATURE (3)..(3): X = S or I
  MISC_FEATURE (5)..(5): X = S or N
  MISC_FEATURE (6)..(6): X = V or I
  MISC_FEATURE (8)..(8): X = Y or H or S or F
  MISC_FEATURE (9)..(9): X = S or N or I or R or H
  MISC_FEATURE (11)..(11): X = N or H
  MISC_FEATURE (12)..(12): X = N or S or D
  MISC_FEATURE (13)..(13): X = N or Y or K or H or A or M or Q
  MISC_FEATURE (14)..(14): X = N or K
  MISC_FEATURE (15)..(15): X = Y or F
  MISC_FEATURE (17)..(17): X = A or T or D
XSXQXXLXXSXXXXXLX

SEQ ID NO: 50157 - protein, 7 aa, Artificial
  Synthetic
  MISC_FEATURE (2)..(2): X = A or T or G or S
  MISC_FEATURE (3)..(3): X = S or F
  MISC_FEATURE (4)..(4): X = T or I
  MISC_FEATURE (6)..(6): X = E or K or D
  MISC_FEATURE (7)..(7): X = S or F
WXXXRXX

SEQ ID NO: 50158 - protein, 9 aa, Artificial
  Synthetic
  MISC_FEATURE (1)..(1): X = Q or H
  MISC_FEATURE (2)..(2): X = Q or H
  MISC_FEATURE (3)..(3): X = Y or S
  MISC_FEATURE (4)..(4): X = Y or F or K or N
  MISC_FEATURE (5)..(5): X = S or T or I or Absent or N
  MISC_FEATURE (6)..(6): X = T or S or I or R or A or G or N
  MISC_FEATURE (7)..(7): X = P or S
  MISC_FEATURE (8)..(8): X = C or Y or G or L or P
  MISC_FEATURE (9)..(9): X = S or K or N
XXXXXXXXX

SEQ ID NO: 50159 - protein, 11 aa, Artificial
  Synthetic
  MISC_FEATURE (3)..(3): X = S or N
  MISC_FEATURE (5)..(5): X = G or D or F or N or V
  MISC_FEATURE (6)..(6): X = I or L or V
  MISC_FEATURE (7)..(7): X = S or N or T or I or F or G
  MISC_FEATURE (8)..(8): X = N or S or D or T or R
  MISC_FEATURE (9)..(9): X = W or C
RAXQXXXXXLA

SEQ ID NO: 50160 - protein, 7 aa, Artificial
  Synthetic
  MISC_FEATURE (1)..(1): X = A or G or D or T or S
  MISC_FEATURE (2)..(2): X = A or V or P or T
  MISC_FEATURE (3)..(3): X = S or F
  MISC_FEATURE (4)..(4): X = S or N
  MISC_FEATURE (7)..(7): X = S or G or N
XXXXLQX

SEQ ID NO: 50161 - protein, 9 aa, Artificial
  Synthetic
  MISC_FEATURE (1)..(1): X = Q or L
  MISC_FEATURE (3)..(3): X = A or T or S or G or V or Y
  MISC_FEATURE (4)..(4): X = N or D or H or Y
  MISC_FEATURE (6)..(6): X = F or L
  MISC_FEATURE (8)..(8): X = W or R or P
XQXXSXPXT

SEQ ID NO: 50162 - protein, 17 aa, Artificial
  Synthetic
  MISC_FEATURE (3)..(3): X = S or N
  MISC_FEATURE (5)..(5): X = S or R or N
  MISC_FEATURE (6)..(6): X = V or I or L
  MISC_FEATURE (7)..(7): X = L or F
  MISC_FEATURE (8)..(8): X = H or F or Y or K or S
  MISC_FEATURE (9)..(9): X = S or N or H
  MISC_FEATURE (11)..(11): X = N or H
  MISC_FEATURE (12)..(12): X = N or S
  MISC_FEATURE (13)..(13): X = N or K or Y or H
  MISC_FEATURE (14)..(14): X = N or R or S
  MISC_FEATURE (17)..(17): X = A or T or V
KSXQXXXXXSXXXXYLX

SEQ ID NO: 50163 - protein, 7 aa, Artificial
  Synthetic
  MISC_FEATURE (4)..(4): X = T or A or I or S
  MISC_FEATURE (5)..(5): X = R or L
  MISC_FEATURE (6)..(6): X = E or K or D
WASXXXS

SEQ ID NO: 50164 - protein, 9 aa, Artificial
  Synthetic
  MISC_FEATURE (1)..(1): X = Q or H
  MISC_FEATURE (3)..(3): X = Y or S
  MISC_FEATURE (4)..(4): X = Y or C or F or S or H
  MISC_FEATURE (5)..(5): X = S or N or Q or D or T
  MISC_FEATURE (6)..(6): X = T or L or I or A or F or S
  MISC_FEATURE (8)..(8): X = V or F or P
XQXXXXPXT

SEQ ID NO: 50165 - protein, 14 aa, Artificial
  Synthetic
  MISC_FEATURE (1)..(1): X = A or V or G
  MISC_FEATURE (2)..(2): X = S or F or L
  MISC_FEATURE (3)..(3): X = S or N
  MISC_FEATURE (5)..(5): X = G or E
  MISC_FEATURE (6)..(6): X = A or S or T
  MISC_FEATURE (10)..(10): X = G or A
  MISC_FEATURE (11)..(11): X = Y or S or N or F
  MISC_FEATURE (12)..(12): X = Y or F
  MISC_FEATURE (14)..(14): X = N or S or Q
XXXTXXVTSXXXPX

SEQ ID NO: 50166 - protein, 7 aa, Artificial
  Synthetic
  MISC_FEATURE (1)..(1): X = S or H or N
  MISC_FEATURE (3)..(3): X = S or N or D or I or T
  MISC_FEATURE (5)..(5): X = K or R
XTXNXHS

SEQ ID NO: 50167 - protein, 10 aa, Artificial
  Synthetic
  MISC_FEATURE (1)..(1): X = L or M
  MISC_FEATURE (2)..(2): X = L or I or F
  MISC_FEATURE (3)..(3): X = Y or F
  MISC_FEATURE (4)..(4): X = Y or C or F or S
  MISC_FEATURE (5)..(5): X = G or D
  MISC_FEATURE (7)..(7): X = A or V
  MISC_FEATURE (8)..(8): X = Q or H
  MISC_FEATURE (9)..(9): X = L or V or M
  MISC_FEATURE (10)..(10): X = V or A or I or G or M
XXXXXGXXXX

SEQ ID NO: 50168 - protein, 11 aa, Artificial
  Synthetic
  MISC_FEATURE (2)..(2): X = A or S
  MISC_FEATURE (4)..(4): X = Q or L or M or V
  MISC_FEATURE (5)..(5): X = S or N or D or R or T
  MISC_FEATURE (6)..(6): X = V or I
  MISC_FEATURE (7)..(7): X = N or K or S or V or A or I or L
  MISC_FEATURE (8)..(8): X = S or N or T
  MISC_FEATURE (9)..(9): X = N or S or Y
RXSXXXXXXLA

SEQ ID NO: 50169 - protein, 7 aa, Artificial
  Synthetic
  MISC_FEATURE (1)..(1): X = G or I or F or V
  MISC_FEATURE (2)..(2): X = A or T
  MISC_FEATURE (4)..(4): X = T or I
XXSXRAT

SEQ ID NO: 50170 - protein, 10 aa, Artificial
  Synthetic
  MISC_FEATURE (2)..(2): X = Q or E
  MISC_FEATURE (3)..(3): X = Y or F
  MISC_FEATURE (4)..(4): X = N or Y or D
  MISC_FEATURE (5)..(5): X = D or N
  MISC_FEATURE (6)..(6): X = Absent or W
  MISC_FEATURE (7)..(7): X = W or P
  MISC_FEATURE (8)..(8): X = P or L or M
QXXXXXXXCS

SEQ ID NO: 50171 - protein, 12 aa, Artificial
  Synthetic
  MISC_FEATURE (2)..(2): X = A or S
  MISC_FEATURE (4)..(4): X = Q or E
  MISC_FEATURE (5)..(5): X = S or R
  MISC_FEATURE (6)..(6): X = V or I
  MISC_FEATURE (7)..(7): X = S or T
  MISC_FEATURE (8)..(8): X = S or T
  MISC_FEATURE (9)..(9): X = S or N
  MISC_FEATURE (10)..(10): X = Y or A
  MISC_FEATURE (12)..(12): X = V or S
RXSXXXXXXXLX

SEQ ID NO: 50172 - protein, 7 aa, Artificial
  Synthetic
  MISC_FEATURE (4)..(4): X = T or S
  MISC_FEATURE (7)..(7): X = T or S or I
GASXRAX

SEQ ID NO: 50173 - protein, 9 aa, Artificial
  Synthetic
  MISC_FEATURE (4)..(4): X = G or V
  MISC_FEATURE (5)..(5): X = C or N or S
  MISC_FEATURE (7)..(7): X = P or L
QQYXXSXLT

SEQ ID NO: 50174 - protein, 16 aa, Artificial
  Synthetic
  MISC_FEATURE (5)..(5): X = S or T
  MISC_FEATURE (7)..(7): X = L or Q
  MISC_FEATURE (8)..(8): X = H or R
  MISC_FEATURE (9)..(9): X = S or G
  MISC_FEATURE (10)..(10): X = E or D
  MISC_FEATURE (12)..(12): X = K or R
  MISC_FEATURE (14)..(14): X = Y or H or F
  MISC_FEATURE (16)..(16): X = Y or N
KSSQXLXXXXGXTXLX

SEQ ID NO: 50175 - protein, 7 aa, Artificial
  Synthetic
  MISC_FEATURE (2)..(2): X = V or I
  MISC_FEATURE (4)..(4): X = N or Y or H
  MISC_FEATURE (6)..(6): X = F or I or V or L
EXSXRXS

SEQ ID NO: 50176 - protein, 9 aa, Artificial
  Synthetic
  MISC_FEATURE (1)..(1): X = M or F
  MISC_FEATURE (2)..(2): X = Q or H
  MISC_FEATURE (3)..(3): X = S or G or N
  MISC_FEATURE (4)..(4): X = I or K or T
  MISC_FEATURE (5)..(5): X = Q or Absent or K or H
  MISC_FEATURE (6)..(6): X = L or Q or Y or F or H
  MISC_FEATURE (7)..(7): X = P or L or V
  MISC_FEATURE (8)..(8): X = L or F or P
  MISC_FEATURE (9)..(9): X = T or P or S
XXXXXXXXX

SEQ ID NO: 50177 - protein, 14 aa, Artificial
  Synthetic
  MISC_FEATURE (7)..(7): X = V or I
  MISC_FEATURE (9)..(9): X = G or S
  MISC_FEATURE (12)..(12): X = Y or F
TGTSSDXGXYNXVS

SEQ ID NO: 50178 - protein, 7 aa, Artificial
  Synthetic
  MISC_FEATURE (3)..(3): X = S or R
EVXNRPS

SEQ ID NO: 50179 - protein, 10 aa, Artificial
  Synthetic
  MISC_FEATURE (1)..(1): X = N or G or C or S
  MISC_FEATURE (4)..(4): X = T or V or K
  MISC_FEATURE (5)..(5): X = R or S or K
  MISC_FEATURE (6)..(6): X = S or G or N or R
  MISC_FEATURE (7)..(7): X = I or S or Y
XSYXXXXTWV

SEQ ID NO: 50180 - protein, 11 aa, Artificial
  Synthetic
  MISC_FEATURE (2)..(2): X = A or S
  MISC_FEATURE (4)..(4): X = Q or H or R
  MISC_FEATURE (5)..(5): X = S or N or T or H
  MISC_FEATURE (7)..(7): X = S or N or G or T
  MISC_FEATURE (8)..(8): X = N or S or R
  MISC_FEATURE (9)..(9): X = Y or F
RXSXXIXXXLN

SEQ ID NO: 50181 - protein, 7 aa, Artificial
  Synthetic
  MISC_FEATURE (1)..(1): X = A or T or S or V
  MISC_FEATURE (2)..(2): X = A or T or E or V
  MISC_FEATURE (3)..(3): X = S or L
  MISC_FEATURE (4)..(4): X = S or N
  MISC_FEATURE (6)..(6): X = Q or H
  MISC_FEATURE (7)..(7): X = S or I
XXXXLXX

SEQ ID NO: 50182 - protein, 10 aa, Artificial
  Synthetic
  MISC_FEATURE (3)..(3): X = S or G or T
  MISC_FEATURE (5)..(5): X = S or T or N or R
  MISC_FEATURE (6)..(6): X = T or S or Absent
  MISC_FEATURE (7)..(7): X = P or I
  MISC_FEATURE (8)..(8): X = T or P or Q or L
QQXYXXXXWT

SEQ ID NO: 50183 - protein, 11 aa, Artificial
  Synthetic
  MISC_FEATURE (5)..(5): X = G or D
  MISC_FEATURE (8)..(8): X = S or N or I or K
  MISC_FEATURE (9)..(9): X = W or Y
RASQXISXXLA

SEQ ID NO: 50184 - protein, 7 aa, Artificial
  Synthetic
  MISC_FEATURE (7)..(7): X = S or G
AASSLQX

SEQ ID NO: 50185 - protein, 9 aa, Artificial
  Synthetic
  MISC_FEATURE (3)..(3): X = I or T or V or A or G
  MISC_FEATURE (4)..(4): X = N or K
QQXXSFPLT

SEQ ID NO: 50186 - protein, 11 aa, Artificial
  Synthetic
  MISC_FEATURE (3)..(3): X = S or N
  MISC_FEATURE (5)..(5): X = D or Y
  MISC_FEATURE (7)..(7): X = N or S or T or F or Y
  MISC_FEATURE (8)..(8): X = N or D
  MISC_FEATURE (9)..(9): X = Y or F
QAXQXIXXXLN

SEQ ID NO: 50187 - protein, 7 aa, Artificial
  Synthetic
  MISC_FEATURE (2)..(2): X = A or G
  MISC_FEATURE (4)..(4): X = N or T or D or S
DXSXLET

SEQ ID NO: 50188 - protein, 9 aa, Artificial
  Synthetic
  MISC_FEATURE (3)..(3): X = Y or F
  MISC_FEATURE (4)..(4): X = D or E
  MISC_FEATURE (5)..(5): X = N or Absent or I
  MISC_FEATURE (6)..(6): X = L or N or V
  MISC_FEATURE (7)..(7): X = P or L
QQXXXXXIT

SEQ ID NO: 50189 - protein, 13 aa, Artificial
  Synthetic
  MISC_FEATURE (7)..(7): X = I or L
  MISC_FEATURE (9)..(9): X = N or S
  MISC_FEATURE (10)..(10): X = N or H or K
  MISC_FEATURE (11)..(11): X = Y or F
  MISC_FEATURE (12)..(12): X = V or L
SGSSSNXGXXXXS

SEQ ID NO: 50190 - protein, 7 aa, Artificial
  Synthetic
  MISC_FEATURE (2)..(2): X = N or S
  MISC_FEATURE (3)..(3): X = N or Y or S
DXXKRPS

SEQ ID NO: 50191 - protein, 11 aa, Artificial
  Synthetic
  MISC_FEATURE (2)..(2): X = T or A or I
  MISC_FEATURE (5)..(5): X = S or G or I or R
  MISC_FEATURE (6)..(6): X = S or R
  MISC_FEATURE (8)..(8): X = S or N
  MISC_FEATURE (9)..(9): X = V or A or T
  MISC_FEATURE (10)..(10): X = G or V or M
GXWDXXLXXXV

SEQ ID NO: 50192 - protein, 13 aa, Artificial
  Synthetic
  MISC_FEATURE (3)..(3): X = S or T
  MISC_FEATURE (4)..(4): X = S or N
  MISC_FEATURE (6)..(6): X = N or Y
  MISC_FEATURE (9)..(9): X = S or N
  MISC_FEATURE (10)..(10): X = N or Y
  MISC_FEATURE (11)..(11): X = T or A or S
  MISC_FEATURE (12)..(12): X = V or I
  MISC_FEATURE (13)..(13): X = N or D or S
SGXXSXIGXXXXX

SEQ ID NO: 50193 - protein, 7 aa, Artificial
  Synthetic
  MISC_FEATURE (1)..(1): X = S or I
  MISC_FEATURE (2)..(2): X = N or S
  MISC_FEATURE (3)..(3): X = N or D or S
  MISC_FEATURE (4)..(4): X = Q or H
XXXXRPS

SEQ ID NO: 50194 - protein, 12 aa, Artificial
  Synthetic
  MISC_FEATURE (1)..(1): X = A or E
  MISC_FEATURE (6)..(6): X = S or Absent
  MISC_FEATURE (7)..(7): X = Absent or L
  MISC_FEATURE (8)..(8): X = L or N or M or S
  MISC_FEATURE (9)..(9): X = N or G or K or L
  MISC_FEATURE (10)..(10): X = G or H or N
  MISC_FEATURE (11)..(11): X = V or P or G
  MISC_FEATURE (12)..(12): X = V or P
XAWDDXXXXXXX

SEQ ID NO: 50195 - protein, 13 aa, Artificial
  Synthetic
  MISC_FEATURE (4)..(4): X = S or N or C
  MISC_FEATURE (9)..(9): X = S or N
  MISC_FEATURE (10)..(10): X = N or H
  MISC_FEATURE (11)..(11): X = I or T
  MISC_FEATURE (13)..(13): X = T or N
SGSXSNIGXXXVX

SEQ ID NO: 50196 - protein, 7 aa, Artificial
  Synthetic
  MISC_FEATURE (1)..(1): X = S or G or N or V
  MISC_FEATURE (3)..(3): X = D or K or N or Y
XNXQRPS

SEQ ID NO: 50197 - protein, 11 aa, Artificial
  Synthetic
  MISC_FEATURE (1)..(1): X = A or T
  MISC_FEATURE (2)..(2): X = A or T or V
  MISC_FEATURE (8)..(8): X = N or I or S
  MISC_FEATURE (9)..(9): X = G or D or V
XXWDDSLXXWV

SEQ ID NO: 50198 - protein, 11 aa, Artificial
  Synthetic
  MISC_FEATURE (2)..(2): X = A or T
  MISC_FEATURE (5)..(5): X = G or D or R
  MISC_FEATURE (6)..(6): X = I or V
  MISC_FEATURE (8)..(8): X = N or S
RXSQXXRXDLG

SEQ ID NO: 50199 - protein, 7 aa, Artificial
  Synthetic
  MISC_FEATURE (1)..(1): X = A or D or I or T
  MISC_FEATURE (4)..(4): X = S or N
  MISC_FEATURE (6)..(6): X = Q or E or F or L
XASXLXS

SEQ ID NO: 50200 - protein, 10 aa, Artificial
  Synthetic
  MISC_FEATURE (1)..(1): X = L or I
  MISC_FEATURE (2)..(2): X = Q or H
  MISC_FEATURE (3)..(3): X = H or Y
  MISC_FEATURE (4)..(4): X = N or H or S
  MISC_FEATURE (5)..(5): X = S or N
  MISC_FEATURE (6)..(6): X = Absent or Y
  MISC_FEATURE (7)..(7): X = Y or L or F or P
  MISC_FEATURE (9)..(9): X = I or P or L
XXXXXXXPXT

SEQ ID NO: 50201 - protein, 11 aa, Artificial
  Synthetic
  MISC_FEATURE (2)..(2): X = A or T
  MISC_FEATURE (5)..(5): X = S or N or Y
  MISC_FEATURE (6)..(6): X = I or S or F
  MISC_FEATURE (7)..(7): X = S or F or N or R or T
  MISC_FEATURE (8)..(8): X = S or D or G or R
  MISC_FEATURE (10)..(10): X = L or S
  MISC_FEATURE (11)..(11): X = N or S
RXSQXXXXYXX

SEQ ID NO: 50202 - protein, 7 aa, Artificial
  Synthetic
  MISC_FEATURE (1)..(1): X = A or D or G or S
  MISC_FEATURE (2)..(2): X = A or T
  MISC_FEATURE (3)..(3): X = S or Y
  MISC_FEATURE (4)..(4): X = S or T
  MISC_FEATURE (5)..(5): X = L or F
  MISC_FEATURE (6)..(6): X = Q or E or K
  MISC_FEATURE (7)..(7): X = S or T
XXXXXXX

SEQ ID NO: 50203 - protein, 9 aa, Artificial
  Synthetic
  MISC_FEATURE (1)..(1): X = Q or H
  MISC_FEATURE (2)..(2): X = Q or E
  MISC_FEATURE (3)..(3): X = S or T
  MISC_FEATURE (4)..(4): X = Y or F
  MISC_FEATURE (5)..(5): X = S or G or N
  MISC_FEATURE (6)..(6): X = I or T or L or N or S
  MISC_FEATURE (7)..(7): X = P or S or R or T
  MISC_FEATURE (8)..(8): X = I or F or P
  MISC_FEATURE (9)..(9): X = T or A
XXXXXXXXX

SEQ ID NO: 50204 - protein, 16 aa, Artificial
  Synthetic
  MISC_FEATURE (1)..(1): X = K or R
  MISC_FEATURE (2)..(2): X = S or T
  MISC_FEATURE (3)..(3): X = S or N
  MISC_FEATURE (5)..(5): X = S or I
  MISC_FEATURE (6)..(6): X = L or F
  MISC_FEATURE (7)..(7): X = L or V
  MISC_FEATURE (9)..(9): X = S or N or R
  MISC_FEATURE (10)..(10): X = E or D
  MISC_FEATURE (12)..(12): X = K or R
XXXQXXXHXXGXTYLY

SEQ ID NO: 50205 - protein, 7 aa, Artificial
  Synthetic
  MISC_FEATURE (2)..(2): X = V or L
  MISC_FEATURE (4)..(4): X = N or K or H
  MISC_FEATURE (6)..(6): X = F or L or V
EXSXRXS

SEQ ID NO: 50206 - protein, 12 aa, Artificial
  Synthetic
  MISC_FEATURE (4)..(4): X = Q or R
  MISC_FEATURE (5)..(5): X = S or G or N
  MISC_FEATURE (6)..(6): X = V or I
  MISC_FEATURE (7)..(7): X = I or S or G
  MISC_FEATURE (8)..(8): X = S or N
  MISC_FEATURE (9)..(9): X = S or I or N
  MISC_FEATURE (10)..(10): X = Y or F
RASXXXXXXXLA

SEQ ID NO: 50207 - protein, 7 aa, Artificial
  Synthetic
  MISC_FEATURE (2)..(2): X = V or A or T
  MISC_FEATURE (4)..(4): X = S or N or T
  MISC_FEATURE (5)..(5): X = R or W
GXSXXAT

SEQ ID NO: 50208 - protein, 9 aa, Artificial
  Synthetic
  MISC_FEATURE (1)..(1): X = Q or H
  MISC_FEATURE (2)..(2): X = Q or H
  MISC_FEATURE (3)..(3): X = Y or N
  MISC_FEATURE (4)..(4): X = G or D
  MISC_FEATURE (5)..(5): X = R or Absent or N or Y
  MISC_FEATURE (7)..(7): X = P or L or M
  MOD_RES (8)..(8): Any amino acid
  MISC_FEATURE (9)..(9): X = N or T
XXXXXSXXN

SEQ ID NO: 50209 - protein, 11 aa, Artificial
  Synthetic
  MISC_FEATURE (2)..(2): X = A or S
  MISC_FEATURE (5)..(5): X = S or D or T
  MISC_FEATURE (6)..(6): X = V or I
  MISC_FEATURE (7)..(7): X = S or N or R or I
  MISC_FEATURE (8)..(8): X = S or I or T
  MISC_FEATURE (9)..(9): X = N or Y
  MISC_FEATURE (10)..(10): X = L or I
RXSQXXXXXXA

SEQ ID NO: 50210 - protein, 7 aa, Artificial
  Synthetic
  MISC_FEATURE (7)..(7): X = T or S
GASTRAX

SEQ ID NO: 50211 - protein, 10 aa, Artificial
  Synthetic
  MISC_FEATURE (2)..(2): X = Q or E
  MISC_FEATURE (3)..(3): X = Y or S
  MISC_FEATURE (4)..(4): X = N or D or F or H
  MISC_FEATURE (5)..(5): X = D or N or Absent or T
  MISC_FEATURE (6)..(6): X = Absent or W
  MISC_FEATURE (7)..(7): X = W or P or C or N
  MISC_FEATURE (8)..(8): X = P or L or W
  MISC_FEATURE (9)..(9): X = W or L or C or P or R
  MISC_FEATURE (10)..(10): X = T or P or S
QXXXXXXXXX

SEQ ID NO: 50212 - protein, 11 aa, Artificial
  Synthetic
  MISC_FEATURE (1)..(1): X = R or Q
  MISC_FEATURE (5)..(5): X = G or D
  MISC_FEATURE (7)..(7): X = S or N
  MISC_FEATURE (8)..(8): X = N or K
  MISC_FEATURE (9)..(9): X = Y or F
  MISC_FEATURE (11)..(11): X = A or N or V
XASQXIXXXLX

SEQ ID NO: 50213 - protein, 7 aa, Artificial
  Synthetic
  MISC_FEATURE (1)..(1): X = A or D or G or T
  MISC_FEATURE (3)..(3): X = S or T
  MISC_FEATURE (4)..(4): X = S or R or N
  MISC_FEATURE (6)..(6): X = Q or H or L or V
  MISC_FEATURE (7)..(7): X = S or T
XAXXLXX

SEQ ID NO: 50214 - protein, 9 aa, Artificial
  Synthetic
  MISC_FEATURE (1)..(1): X = Q or H or L
  MISC_FEATURE (2)..(2): X = Q or H or L
  MISC_FEATURE (4)..(4): X = L or H or D or K or N or Y
  MISC_FEATURE (5)..(5): X = S or N or H or T
  MISC_FEATURE (6)..(6): X = Y or L
  MISC_FEATURE (8)..(8): X = I or L
XXYXXXPXT

SEQ ID NO: 50215 - protein, 11 aa, Artificial
  Synthetic
  MISC_FEATURE (1)..(1): X = S or N
  MISC_FEATURE (3)..(3): X = S or N
  MISC_FEATURE (6)..(6): X = S or R
XAXQSXGSSLH

SEQ ID NO: 50216 - protein, 7 aa, Artificial
  Synthetic
  MISC_FEATURE (6)..(6): X = F or L
YASQSXS

SEQ ID NO: 50217 - protein, 9 aa, Artificial
  Synthetic
  MISC_FEATURE (3)..(3): X = S or T
  MISC_FEATURE (4)..(4): X = R or G or S
  MISC_FEATURE (5)..(5): X = R or S or T
HQXXXLPLT

SEQ ID NO: 50218 - protein, 11 aa, Artificial
  Synthetic
  MISC_FEATURE (4)..(4): X = S or T or K
  MISC_FEATURE (7)..(7): X = P or N or S or T
  MISC_FEATURE (10)..(10): X = A or V
  MISC_FEATURE (11)..(11): X = S or N
QGDXLRXYYXX

SEQ ID NO: 50219 - protein, 7 aa, Artificial
  Synthetic
  MISC_FEATURE (1)..(1): X = G or A or T
  MISC_FEATURE (4)..(4): X = N or S
XKNXRPS

SEQ ID NO: 50220 - protein, 12 aa, Artificial
  Synthetic
  MISC_FEATURE (6)..(6): X = S or C
  MISC_FEATURE (7)..(7): X = G or Absent
  MISC_FEATURE (8)..(8): X = N or G
  MISC_FEATURE (9)..(9): X = H or N or S
  MISC_FEATURE (10)..(10): X = L or H
  MISC_FEATURE (11)..(11): X = V or L
  MISC_FEATURE (12)..(12): X = V or L
NSRDSXXXXXXX

SEQ ID NO: 50221 - protein, 16 aa, Artificial
  Synthetic
  MISC_FEATURE (3)..(3): X = S or G
  MISC_FEATURE (14)..(14): X = Y or S
RSXQSLVYSDGNTXLN

SEQ ID NO: 50222 - protein, 7 aa, Artificial
  Synthetic
  MISC_FEATURE (1)..(1): X = K or E
  MISC_FEATURE (4)..(4): X = N or K
  MISC_FEATURE (7)..(7): X = S or Y
XVSXWDX

SEQ ID NO: 50223 - protein, 9 aa, Artificial
  Synthetic
  MISC_FEATURE (4)..(4): X = T or I
  MISC_FEATURE (5)..(5): X = H or Absent
  MISC_FEATURE (6)..(6): X = W or H
  MISC_FEATURE (7)..(7): X = P or L or S or W
  MISC_FEATURE (8)..(8): L or P
  MISC_FEATURE (8)..(8): X = L or P
MQGXXXXXT

SEQ ID NO: 50224 - protein, 11 aa, Artificial
  Synthetic
  MISC_FEATURE (2)..(2): X = A or P or T
  MISC_FEATURE (6)..(6): X = V or F
  MISC_FEATURE (7)..(7): X = S or R or W
  MISC_FEATURE (8)..(8): X = R or I or S
  MISC_FEATURE (9)..(9): X = N or D or S
  MISC_FEATURE (10)..(10): X = L or V
RXSQSXXXXXA

SEQ ID NO: 50225 - protein, 7 aa, Artificial
  Synthetic
  MISC_FEATURE (1)..(1): X = G or D
  MISC_FEATURE (3)..(3): X = S or A
  MISC_FEATURE (4)..(4): X = T or I or A
XAXXRAT

SEQ ID NO: 50226 - protein, 10 aa, Artificial
  Synthetic
  MISC_FEATURE (4)..(4): X = N or Y
  MISC_FEATURE (5)..(5): X = N or T or Y
  MISC_FEATURE (6)..(6): X = Absent or W
  MISC_FEATURE (7)..(7): X = W or P
QQYXXXXPLT

SEQ ID NO: 50227 - protein, 13 aa, Artificial
  Synthetic
HDFWSGYYKGMDV

SEQ ID NO: 50228 - protein, 10 aa, Artificial
  Synthetic
  MISC_FEATURE (1)..(1): X = Q or L or K
  MISC_FEATURE (2)..(2): X = A or T
  MISC_FEATURE (3)..(3): X = W or R
  MISC_FEATURE (4)..(4): X = D or H or V or N or G
  MISC_FEATURE (5)..(5): X = S or N or Absent or I or R or K or T
  MISC_FEATURE (6)..(6): X = Absent or S or N or R
  MISC_FEATURE (7)..(7): X = S or T or N or R or G or F or I or V or Y
  MISC_FEATURE (8)..(8): X = T or S or Y or A or F or P or N or K or I or R
  MISC_FEATURE (9)..(9): X = V or A or T or M or L or G
  MISC_FEATURE (10)..(10): X = V or I or L or A or M
XXXXXXXXXX

SEQ ID NO: 50229 - protein, 7 aa, Artificial
  Synthetic
  MISC_FEATURE (2)..(2): X = A or T or S
  MISC_FEATURE (3)..(3): X = S or F
  MISC_FEATURE (4)..(4): X = T or I or K or S
  MISC_FEATURE (5)..(5): X = R or W or L
  MISC_FEATURE (6)..(6): X = E or K or A or D or R
  MISC_FEATURE (7)..(7): X = S or T
WXXXXXX

SEQ ID NO: 50230 - protein, 7 aa, Artificial
  Synthetic
  MISC_FEATURE (2)..(2): X = G or V
  MISC_FEATURE (3)..(3): X = D or V or G or S
  MISC_FEATURE (5)..(5): X = Y or H
  MISC_FEATURE (7)..(7): X = N or S
SXXYXWX

SEQ ID NO: 50231 - protein, 16 aa, Artificial
  Synthetic
  MISC_FEATURE (1)..(1): X = Y or N or F
  MISC_FEATURE (2)..(2): X = I or L
  MISC_FEATURE (3)..(3): X = F or Y or H
  MISC_FEATURE (4)..(4): X = Y or H
  MISC_FEATURE (10)..(10): X = Y or N
  MISC_FEATURE (15)..(15): X = K or R
XXXXSGSTYXNPSLXS

SEQ ID NO: 50232 - protein, 17 aa, Artificial
  Synthetic
  MISC_FEATURE (11)..(11): X = Y or F or H
  MISC_FEATURE (13)..(13): X = Y or H
  MISC_FEATURE (15)..(15): X = M or L
GDYDGSGSYHXYXGXDV

SEQ ID NO: 50233 - protein, 5 aa, Artificial
  Synthetic
  MISC_FEATURE (1)..(1): X = G or V or P or A or D or Y
  MISC_FEATURE (2)..(2): X = Y or C or S or P
  MISC_FEATURE (3)..(3): Y or F
  MISC_FEATURE (3)..(3): X = Y or F
XXXWS

SEQ ID NO: 50234 - protein, 16 aa, Artificial
  Synthetic
  MISC_FEATURE (2)..(2): X = I or S or V
  MISC_FEATURE (4)..(4): X = H or I or Q
  MISC_FEATURE (7)..(7): X = R or S
  MISC_FEATURE (8)..(8): X = T or A or S
  MISC_FEATURE (9)..(9): X = N or T
  MISC_FEATURE (10)..(10): X = Y or F
EXNXSGXXXXNPSLKS

SEQ ID NO: 50235 - protein, 7 aa, Artificial
  Synthetic
DYGGLDY

SEQ ID NO: 50236 - protein, 14 aa, Artificial
  Synthetic
  MISC_FEATURE (10)..(10): X = Y or F
DWGGYSSYYXGMDV

SEQ ID NO: 50237 - protein, 5 aa, Artificial
  Synthetic
  MISC_FEATURE (1)..(1): X = S or N or T
  MISC_FEATURE (2)..(2): X = Y or F
  MISC_FEATURE (3)..(3): G or D or N
  MISC_FEATURE (3)..(3): X = G or D or N
XXXMH

SEQ ID NO: 50238 - protein, 17 aa, Artificial
  Synthetic
  MISC_FEATURE (1)..(1): X = V or A
  MISC_FEATURE (4)..(4): X = Y or H
  MISC_FEATURE (7)..(7): X = S or R
  MISC_FEATURE (8)..(8): X = N or D or H
  MISC_FEATURE (9)..(9): X = K or R
  MISC_FEATURE (11)..(11): X = Y or C or S
  MISC_FEATURE (12)..(12): X = A or E or T
XIWXDGXXXYXXDSVKG

SEQ ID NO: 50239 - protein, 12 aa, Artificial
  Synthetic
  MISC_FEATURE (2)..(2): X = R or D or H
  MISC_FEATURE (3)..(3): X = P or S or A
  MISC_FEATURE (4)..(4): X = I or R or Y
  MISC_FEATURE (5)..(5): X = S or L or V or W
  MISC_FEATURE (6)..(6): X = Absent or G
  MISC_FEATURE (7)..(7): X = Absent or A
  MISC_FEATURE (8)..(8): X = S or T or A
  MISC_FEATURE (9)..(9): X = A or F or S or Y
  MISC_FEATURE (10)..(10): X = F or G or S
  MISC_FEATURE (12)..(12): X = Y or F
DXXXXXXXXXDX

SEQ ID NO: 50240 - protein, 5 aa, Artificial
  Synthetic
  MISC_FEATURE (1)..(1): X = S or N
  MISC_FEATURE (3)..(3): X = N or S
XYXMN

SEQ ID NO: 50241 - protein, 17 aa, Artificial
  Synthetic
  MISC_FEATURE (4)..(4): X = R or S
  MISC_FEATURE (6)..(6): X = S or G
  MISC_FEATURE (7)..(7): X = N or S
  MISC_FEATURE (9)..(9): X = K or T
  MISC_FEATURE (10)..(10): X = Y or H
  MISC_FEATURE (12)..(12): X = A or V
  MISC_FEATURE (16)..(16): X = K or R or E or Q
YISXSXXTXXYXDSVXG

SEQ ID NO: 50242 - protein, 16 aa, Artificial
  Synthetic
  MISC_FEATURE (2)..(2): X = R or S
  MISC_FEATURE (3)..(3): X = S or R
  MISC_FEATURE (4)..(4): X = G or K
  MISC_FEATURE (5)..(5): X = S or G
  MISC_FEATURE (6)..(6): X = Y or F
  MISC_FEATURE (7)..(7): X = G or Absent
  MISC_FEATURE (8)..(8): X = Y or Absent
  MISC_FEATURE (9)..(9): X = F or Absent
  MISC_FEATURE (10)..(10): X = Y or Absent
  MISC_FEATURE (14)..(14): X = L or M
DXXXXXXXXXYYGXDV

SEQ ID NO: 50243 - protein, 16 aa, Artificial
  Synthetic
  MISC_FEATURE (2)..(2): X = S or Y
  MISC_FEATURE (7)..(7): X = L or V
  MISC_FEATURE (8)..(8): X = H or Y
  MISC_FEATURE (9)..(9): X = S or N or H
  MISC_FEATURE (10)..(10): X = N or S
  MISC_FEATURE (11)..(11): X = G or K or R
  MISC_FEATURE (12)..(12): X = Y or H or N
  MISC_FEATURE (14)..(14): X = Y or H or S
RXSQSLXXXXXXNXLD

SEQ ID NO: 50244 - protein, 7 aa, Artificial
  Synthetic
  MISC_FEATURE (1)..(1): X = L or V
  MISC_FEATURE (4)..(4): X = N or H
XGSXRAS

SEQ ID NO: 50245 - protein, 10 aa, Artificial
  Synthetic
  MISC_FEATURE (3)..(3): X = A or P or T or V
  MISC_FEATURE (5)..(5): X = H or Q or Absent
  MISC_FEATURE (6)..(6): X = Absent or T
  MISC_FEATURE (7)..(7): X = P or Q or T or I
  MISC_FEATURE (8)..(8): X = P or T
  MISC_FEATURE (9)..(9): X = L or P or F
MQXLXXXXXT

SEQ ID NO: 50246 - protein, 9 aa, Artificial
  Synthetic
  MISC_FEATURE (1)..(1): X = M or I or L
  MISC_FEATURE (4)..(4): X =  I or M
  MISC_FEATURE (5)..(5): X = Q or Absent or L
  MISC_FEATURE (6)..(6): X = L or Y or I or Q
  MISC_FEATURE (7)..(7): X = P or L
  MISC_FEATURE (9)..(9): X = T or I
XQSXXXXIX

SEQ ID NO: 50247 - protein, 11 aa, Artificial
  Synthetic
  MISC_FEATURE (5)..(5): X = G or A
  MISC_FEATURE (7)..(7): X = R or G
  MISC_FEATURE (8)..(8): X = N or D
RASQXIXXDLG

SEQ ID NO: 50248 - protein, 7 aa, Artificial
  Synthetic
  MISC_FEATURE (2)..(2): X = A or T
AXSSLQS

SEQ ID NO: 50249 - protein, 9 aa, Artificial
  Synthetic
  MISC_FEATURE (4)..(4): X = Y or N
  MISC_FEATURE (5)..(5): X = S or N
  MISC_FEATURE (6)..(6): X = Y or F
  MISC_FEATURE (8)..(8): X = R or Y
LQHXXXPXS

SEQ ID NO: 50250 - protein, 11 aa, Artificial
  Synthetic
  MISC_FEATURE (3)..(3): X = N or D
  MISC_FEATURE (6)..(6): X = G or R
  MISC_FEATURE (7)..(7): X = R or S
  MISC_FEATURE (8)..(8): X = K or R
  MISC_FEATURE (9)..(9): X = N or A
GGXNIXXXXVH

SEQ ID NO: 50251 - protein, 7 aa, Artificial
  Synthetic
  MISC_FEATURE (1)..(1): X = R or S
  MISC_FEATURE (3)..(3): X = S or R
  MISC_FEATURE (4)..(4): X = D or N or Y
  MISC_FEATURE (6)..(6): X = P or S
XDXXRXS

SEQ ID NO: 50252 - protein, 11 aa, Artificial
  Synthetic
  MISC_FEATURE (2)..(2): X = V or D
  MISC_FEATURE (6)..(6): X = Absent or S
  MISC_FEATURE (7)..(7): X = Absent or S
  MISC_FEATURE (8)..(8): X = S or D or G
  MISC_FEATURE (9)..(9): X = T or H
  MISC_FEATURE (10)..(10): X = V or A or G
QXWDSXXXXXV

SEQ ID NO: 50253 - protein, 5 aa, Artificial
  Synthetic
  MISC_FEATURE (1)..(1): X = S or N or T
  MISC_FEATURE (4)..(4): X = M or L
XYGXH

SEQ ID NO: 50254 - protein, 17 aa, Artificial
  Synthetic
  MISC_FEATURE (1)..(1): X = I or V or A
  MISC_FEATURE (2)..(2): X = I or M
  MISC_FEATURE (7)..(7): X = S or T
  MISC_FEATURE (8)..(8): X = N or Y or S
  MISC_FEATURE (12)..(12): X = A or G or T or V
XXWYDGXXKYYXDSVKG

SEQ ID NO: 50255 - protein, 12 aa, Artificial
  Synthetic
  MISC_FEATURE (1)..(1): X = D or E
  MISC_FEATURE (2)..(2): X = H or R or Q or A or G or T or Y
  MISC_FEATURE (3)..(3): X = Y or G or F or H
  MISC_FEATURE (4)..(4): X = D or I or F
  MISC_FEATURE (5)..(5): X = F or V or L
  MISC_FEATURE (6)..(6): X = W or G or Absent
  MISC_FEATURE (7)..(7): X = S or A or Absent
  MISC_FEATURE (8)..(8): X = G or T or E
  MISC_FEATURE (9)..(9): X = H or Y or W or F
  MISC_FEATURE (10)..(10): X = F or L or S
  MISC_FEATURE (11)..(11): X = D or A or C or G
  MISC_FEATURE (12)..(12): X = Y or F or S
XXXXXXXXXXXX

SEQ ID NO: 50256 - protein, 11 aa, Artificial
  Synthetic
  MISC_FEATURE (5)..(5): X = S or N
  MISC_FEATURE (8)..(8): X = S or N
  MISC_FEATURE (9)..(9): X = S or N or T
RASQXIGXXLH

SEQ ID NO: 50257 - protein, 7 aa, Artificial
  Synthetic
  MISC_FEATURE (1)..(1): X = Y or S
XASQSFS

SEQ ID NO: 50258 - protein, 9 aa, Artificial
  Synthetic
  MISC_FEATURE (1)..(1): X = H or Q
  MISC_FEATURE (4)..(4): X = S or G or R
  MISC_FEATURE (6)..(6): X = L or F
  MISC_FEATURE (8)..(8): X = W or R or Q
XQSXSXPXT

SEQ ID NO: 50259 - protein, 17 aa, Artificial
  Synthetic
  MISC_FEATURE (8)..(8): X = N or S or Q
  MISC_FEATURE (9)..(9): X = T or A or V
WMYPNSGXXGYAQKFQG

SEQ ID NO: 50260 - protein, 17 aa, Artificial
  Synthetic
  MISC_FEATURE (8)..(8): X = N or S or Q
  MISC_FEATURE (9)..(9): X = T or A or E
WMHPNSGXXGYAQKFQG

SEQ ID NO: 50261 - protein, 9 aa, Artificial
  Synthetic
  MISC_FEATURE (5)..(5): X = N or Q
  MISC_FEATURE (6)..(6): X = T or A
QQYYXXPVT

SEQ ID NO: 50262 - protein, 8 aa, Artificial
  Synthetic
  MISC_FEATURE (1)..(1): X = D or S
  MISC_FEATURE (2)..(2): X = G or A
XXTSSFDY

SEQ ID NO: 50263 - protein, 17 aa, Artificial
  Synthetic
  MISC_FEATURE (5)..(5): X = D or S or E
  MISC_FEATURE (6)..(6): X = G or A
  MISC_FEATURE (13)..(13): X = D or E
  MISC_FEATURE (14)..(14): X = S or A
IIWHXXSNKYYAXXVKG

SEQ ID NO: 50264 - protein, 17 aa, Artificial
  Synthetic
  MISC_FEATURE (6)..(6): X = G or A
  MISC_FEATURE (13)..(13): X = D or E or G
  MISC_FEATURE (14)..(14): X = S or A
VIWYDXSNKYYAXXVKG

SEQ ID NO: 50265 - protein, 14 aa, Artificial
  Synthetic
  MISC_FEATURE (7)..(7): X = W or F
EVYSSGXYDYGMDV

SEQ ID NO: 50266 - protein, 118 aa, Artificial; identical to SEQ ID NO: 29778
  Synthetic

SEQ ID NO: 50267 - protein, 123 aa, Artificial
  Synthetic
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCARERYSSGWYDYGMDVWGQGTTVTVSS

SEQ ID NO: 50268 - protein, 116 aa, Artificial
  Synthetic
QVQLVESGGGVVQPGRSLRLSCAASGFTFSDYGMHWVRQAPGKGLEWVAVIWYDENNKYYADSVKGRFTISRDNSKNTLYLQMNSLRAEDTAVYYCARELGFSDYWGQGTLVTVSS

SEQ ID NO: 50269 - protein, 115 aa, Artificial; identical to SEQ ID NO: 29738
  Synthetic

SEQ ID NO: 50270 - protein, 118 aa, Artificial; identical to SEQ ID NO: 29808
  Synthetic

SEQ ID NO: 50271 - protein, 120 aa, Artificial
  Synthetic
QVQLVESGGGVVQPGRSLRLSCAASGFTFSSYGMHWVRQAPGKGLEWVAVIWYDGSNKNYADSVKGRFTISRDNSKNTLYLQMNSLRAEDTAVYYCARDQGVGYYGLDVWGQGTTVTVSS

SEQ ID NO: 50272 - protein, 117 aa, Artificial
  Synthetic
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDGTSSFDYWGQGTLVTVSS

SEQ ID NO: 50273 - protein, 118 aa, Artificial; identical to SEQ ID NO: 28996
  Synthetic

SEQ ID NO: 50274 - protein, 117 aa, Artificial
  Synthetic
QVQLVESGGGVVQPGRSLRLSCAASGFTFSDYGMHWVRQAPGKGLEWVAVIWYDESNKYYADSVKGRFTISRDNSKNTLYLQMNSLRAEDTAVYYCAREVGWLDDYWGQGTLVTVSS

SEQ ID NO: 50275 - protein, 114 aa, Artificial
  Synthetic
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARDRGSSWGQGTLVTVSS

SEQ ID NO: 50276 - protein, 121 aa, Artificial; identical to SEQ ID NO: 28502
  Synthetic

SEQ ID NO: 50277 - protein, 123 aa, Artificial; identical to SEQ ID NO: 29132
  Synthetic

SEQ ID NO: 50278 - protein, 129 aa, Artificial
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRVYCSSTSCPYYYYYGMDVWGQGTTVTVSS

SEQ ID NO: 50279 - protein, 115 aa, Artificial
  Synthetic
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARVASFDYWGQGTLVTVSS

SEQ ID NO: 50280 - protein, 127 aa, Artificial; identical to SEQ ID NO: 30630
  Synthetic

SEQ ID NO: 50281 - protein, 121 aa, Artificial; identical to SEQ ID NO: 31304
  Synthetic

SEQ ID NO: 50282 - protein, 121 aa, Artificial
  Synthetic
QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARDHYDFWSGHFDYWGQGTLVTVSS

SEQ ID NO: 50283 - protein, 115 aa, Artificial
  Synthetic
QVQLQQWGAGLLKPSETLSLTCAVYGGSFSGYYWSWIRQPPGKGLEWIGEINHSGRTNYNPSLKSRVTISVDTSKNQFSLKLSSVTAADTAVYYCARDYGGLDYWGQGTLVTVSS

SEQ ID NO: 50284 - protein, 119 aa, Artificial
  Synthetic
QLQLQESGPGLVKPSETLSLTCTVSGGSISRSSYYWGWIRQPPGKGLEWIGNIYYSGSTYYNPSLKSRVTISVDTSKNQFSLKLSSVTAADTAVYYCARHSSSWSLDYWGQGTLVTVSS

SEQ ID NO: 50285 - protein, 120 aa, Artificial
  Synthetic
QVQLVQSGAEVKKPGASVKVSCKASGYTFTGYYIHWVRQAPGQGLEWMGWINPNSGGTNYAQKFQGRVTMTRDTSISTAYMELSRLRSDDTAVYYCARGYSYGYNWFDPWGQGTLVTVSS

SEQ ID NO: 50286 - protein, 119 aa, Artificial
  Synthetic
QVQLVESGGGVVQPGRSLRLSCAASGFTFSHYGMHWVRQAPGKGLEWVAVIWYDGSNKYYADSVKGRFTISRDNSKNTLYLQMNSLRAEDTAVYYCARGDWNPEGMDVWGQGTTVTVSS

SEQ ID NO: 50287 - protein, 123 aa, Artificial; identical to SEQ ID NO: 30234
  Synthetic

SEQ ID NO: 50288 - protein, 124 aa, Artificial
  Synthetic
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARSYYYGSGSYYNEFDYWGQGTLVTVSS

SEQ ID NO: 50289 - protein, 123 aa, Artificial; identical to SEQ ID NO: 31196
  Synthetic

SEQ ID NO: 50290 - protein, 114 aa, Artificial
  Synthetic
EVQLVESGGGLVKPGGSLRLSCAASGFTFSSYSMNWVRQAPGKGLEWVSSISGSSSYIYYADSVKGRFTISRDNAKNSLYLQMNSLRAEDTAVYYCARLTFDYWGQGTLVTVSS

SEQ ID NO: 50291 - protein, 122 aa, Artificial
  Synthetic
QVQLVESGGGVVQPGRSLRLSCAASGFTFSTYGMHWVRQAPGKGLEWVAIIWYDGTNKYYADSVKGRFTISRDNSKNTLYLQLNSLRAEDTAVYYCARDPLRGYNDPVMDYWGQGTLVTVSS

SEQ ID NO: 50292 - protein, 122 aa, Artificial; identical to SEQ ID NO: 30134
  Synthetic

SEQ ID NO: 50293 - protein, 129 aa, Artificial
  Synthetic
QVQLVESGGGVVQPGRSLRLSCAASGFTFSTYGMHWVRQAPGKGLEWVAVIWYGGSNKDYADSVKGRFTISRDISKNTLYLQMNSLRAEDTAVYYCARDRDYCSGGSCPYYYYYGMDVWGQGTTVTVSS

SEQ ID NO: 50294 - protein, 119 aa, Artificial
  Synthetic
QLQLQESGPGLVKPSETLSLTCTVSGGSISRSSYYWGWIRQPPGKGLEWIGNIYYSGSTYYNPSLKSRVTISVDTSKNQFSLKLSSVTAADTAVYYCGRHGKDWGLDYWGQGTLVTVSS

SEQ ID NO: 50295 - protein, 124 aa, Artificial
  Synthetic
QVQLVQSGAEVKKPGASVKVSCKASGYTFTGYYMHWVRQAPGQGLEWMGWIKPNSGGTNQAQKFQGRVTMTRDTSISTAYMELSGLRSDDTAVYYCARAPGTAAAGTWGYFDYWGQGTLVTVSS

SEQ ID NO: 50296 - protein, 118 aa, Artificial
  Synthetic
QITLKESGPTLVKPTQTLTLTCTFSGFSLSTGGVGVGWIRQPPGKALEWLALIYWDDDKRYSPSLKSRLTITKDTSKNQVVLTMTNMDPVDTATYYCAHLIAVAFDYWGQGTLVTVSS

SEQ ID NO: 50297 - protein, 121 aa, Artificial
  Synthetic
QVQLVESGGGVVQPGRSLRLSCAASGFTFSSYGMHWVRQAPGKGLEWVAIIWYDGSYKYYADSVKGRFTISRDNSKNTLYLQMNSLRAEDTAVYYCAREAYDFWSGYFDYWGQGTLVTVSS

SEQ ID NO: 50298 - protein, 120 aa, Artificial
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRDYGDYGMDVWGQGTTVTVSS

SEQ ID NO: 50299 - protein, 121 aa, Artificial
  Synthetic
EVQLLESGGGLVQPGGSLRLSCAASGFTFSSYAMSWVRQAPGKGLEWVSAISGSGGNTFYADSVKGRFTISRDNSKNTLYLQMNSLRAEDTAVYYCAKLGKDYYYYGMDVWGQGTTVTVSS

SEQ ID NO: 50300 - protein, 115 aa, Artificial
  Synthetic
EVQLLESGGGLVQPGGSLRLSCAASGFTFSSYVMSWVRQAPGKGLEWVSAMSGSGGRTYYADSVKGRFTISRDNSKNTLYLQMNSLRAEDTAVYYCAKLTAFDYWGQGTLVTVSS

SEQ ID NO: 50301 - protein, 121 aa, Artificial
  Synthetic
QVQLVESGGGVVQPGRSLRLSCAASGFTFSSYGMHWVRQAPGKGLEWVAIISYAGSNKYYADSVKGRFTISRDNSKNTLYLQMNSLRAEDTAVYYCVRRGYSYGGYGMDVWGQGTTVTVSS

SEQ ID NO: 50302 - protein, 123 aa, Artificial
  Synthetic
QVQLVESGGGVVQPGRSLRLSCAASGFTFSDYVMHWVRQAPGKGLEWVAVIWYDGSNKYYADSVKGRFTISRDNSKNTLYLQMNSLRAEDTAVYYCAREPYTSGWYDYGMDVWGQGTTVTVSS

SEQ ID NO: 50303 - protein, 122 aa, Artificial; identical to SEQ ID NO: 31476
  Synthetic

SEQ ID NO: 50304 - protein, 118 aa, Artificial
  Synthetic
EVQLLESGGGLVQPGGSLRLSCAASGFTFSSYAMSWVRQAPGKGLEWVSAISGRGGNTFDADSVKGRFTISRDNSKNTLYLQMNSLRAEDTAVYYCAKERSGSYFDYWGQGTLVTVSS

SEQ ID NO: 50305 - protein, 119 aa, Artificial; identical to SEQ ID NO: 28704
  Synthetic

SEQ ID NO: 50306 - protein, 119 aa, Artificial; identical to SEQ ID NO: 31524
  Synthetic

SEQ ID NO: 50307 - protein, 115 aa, Artificial
  Synthetic
EVQLLESGGGLVQPGGSLRLSCAASGFTFSSYVMNWVRQAPGKGLEWVSAISGSGGRTYYADSVKGRFTISRDNSKNTLYLQMNSLRAEDTAVYYCARTATFDYWGQGTLVTVSS

SEQ ID NO: 50308 - protein, 118 aa, Artificial
  Synthetic
EVQLLESGGGLVQPGGSLRLSCAASGFTFSSYAMSWVRQAPGKGLEWVSVISGRGGTTFYADSVKGRFTISRDNSKNTLYLQMNSLRAEDTAVYYCAKRTPSDVFDIWGQGTMVTVSS

SEQ ID NO: 50309 - protein, 119 aa, Artificial
  Synthetic
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRPRSSAFDYWGQGTLVTVSS

SEQ ID NO: 50310 - protein, 125 aa, Artificial
  Synthetic
EVQLVESGGGLVQPGGSLRLSCAASGFTFSSYNMNWVRQAPGKGLEWVSYISRSSNTKYYADSVKGRFTISRDNAKNSLYLQMNSLRDEDTAVYYCARDRSGSYGYFYYYGLDVWGQGTTVTVSS

SEQ ID NO: 50311 - protein, 119 aa, Artificial
  Synthetic
QVQLQESGPGLVKPSQTLSLTCTVSGGSIRSGGDYWSWIRQHPGKGLEWIGYIYYSGSTYYNPSLKSRVTISVDTSKNQFSLKLSSVTAADTAVYYCARDSSSYGMDVWGQGTTVTVSS

SEQ ID NO: 50312 - protein, 108 aa, Artificial
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKR

SEQ ID NO: 50313 - protein, 107 aa, Artificial
  Synthetic
SYELTQPPSVSVSPGQTASITCSGDKLGDKYACWYQQKPGQSPVLVIYQDRKRPSGIPERFSGSNSGNTATLTISGTQAMDEADYYCQAWDSSTVVFGGGTKLTVLG

SEQ ID NO: 50314 - protein, 109 aa, Artificial
  Synthetic
EIVLTQSPGTLSLSPGERATLSCRASQSVYSSYLAWYQQKPGQAPRLLIYGASSRATGIPDRFSGSGSGTDFTLTISRLEPEDFAVYYCQQYDNSPWTFGQGTKVEIKR

SEQ ID NO: 50315 - protein, 108 aa, Artificial
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRTFGQGTKVEIKR

SEQ ID NO: 50316 - protein, 114 aa, Artificial
  Synthetic
DIVMTQSPDSLAVSLGERATINCKSSQSVLHSSNNNNYLAWYQQKPGQPPKLLIYWASTRESGVPDRFSGSGSGTDFTLTISSLQAEDVAVYYCQQYYSTPPTFGQGTKVEIKR

SEQ ID NO: 50317 - protein, 108 aa, Artificial
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIKR

SEQ ID NO: 50318 - protein, 108 aa, Artificial
  Synthetic
DIQMTQSPSSLSASVGDRVTITCRASQGISNYLAWFQQKPGKAPKSLIYAASSLQSGVPSKFSGSGSGTDFTLTISSLQPEDFATYYCQQYSTYPLTFGGGTKVEIKR

SEQ ID NO: 50319 - protein, 108 aa, Artificial
  Synthetic
DIQMTQSPSSLSASVGDRVTITCRASQNIISYLNWYQQKPGKAPKLLIYTASSLQSGVPSRFSGSGSGTDFTLTISSLQPEDFATYYCQQSYSTPLTFGGGTKVEIKR

SEQ ID NO: 50320 - protein, 108 aa, Artificial
  Synthetic
DIQMTQSPSSLSASVGDRVTITCRASQGISNYLAWFQQKPGKAPKSLIYAASSLQSGVPSKFSGSGSGTDFTLTISSLQPEDFATYYCQQYNSYPFTFGPGTKVDIKR

SEQ ID NO: 50321 - protein, 108 aa, Artificial
  Synthetic
DIQMTQSPSSVSASVGDRVTITCRASQGISRWLAWYQQKPGKAPKLLIYAASSLQSGVPSRFSGSGSGTDFTLTISSLQPEDFATYYCQQANSFPFTFGPGTKVDIKR

SEQ ID NO: 50322 - protein, 113 aa, Artificial
  Synthetic
DIVMTQTPLSLSVTPGQPASISCKSSQSLLHGDGKTYLYWYLQKPGQPPQLLIYEVSNRFSGVPDRFSGSGSGTDFTLKISRVEAEDVGVYYCMQSIQLPWTFGQGTKVEIKR

SEQ ID NO: 50323 - protein, 108 aa, Artificial
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSPPFTFGPGTKVDIKR

SEQ ID NO: 50324 - protein, 114 aa, Artificial
  Synthetic
DIVMTQSPDSLAVSLGERATINCKSSQSVLYSSNNNNYLAWYQQKPGQPPKLLIYWASTRESGVPDRFSGSGSGTDFTLTISSLQAEDVAVYYCQQYYSTPCSFGQGTKLEIKR

SEQ ID NO: 50325 - protein, 108 aa, Artificial
  Synthetic
DIQMTQSPSSVSASVGDRVTITCRASQGISNWLAWYQQKPGKAPKLLIYAASSLQSGVPSRFSGSGSGTDFTLTISSLQPEDFATYYCQQANSFPWTFGQGTKVEIKR

SEQ ID NO: 50326 - protein, 114 aa, Artificial
  Synthetic
DIVMTQSPDSLAVSLGERATINCKSSQSVLHSSNNNNYLAWYQQKPGQPPKLLIYWASTRESGVPDRFSGSGSGTDFTLTISSLQAEDVAVYYCQQYYSTPVTFGPGTKVDIKR

SEQ ID NO: 50327 - protein, 111 aa, Artificial
  Synthetic
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQLVFGGGTKLTVLG

SEQ ID NO: 50328 - protein, 108 aa, Artificial
  Synthetic
EIVMTQSPATLSVSPGERATLSCRASQSVNSNLAWYQQKPGQAPRLLIYGASTRATGIPARFSGSGSGTEFTLTISSLQSEDFAVYYCQQYNDWPCSFGQGTKLEIKR

SEQ ID NO: 50329 - protein, 109 aa, Artificial
  Synthetic
EFMLTQSPGTLSLSPGERATLSCRASQSVSSSYLVWYQQKPGQAPRLLIYGASTRATGIPDRFSGSGSGTDFTLTISRLEPEYFAVYYCQQYGCSPLTFGGGTKVEITR

SEQ ID NO: 50330 - protein, 113 aa, Artificial
  Synthetic
DIVMTQTPLSLSVTPGQPASISCKSSQSLLHSEGKTYLYWYLQKPGQPPQLLIYEVSNRFSGVPDRFSGSGSGTDFTLKISRVEAEDVGVYYCMQSIQLPLTFGGGTKVEIKR

SEQ ID NO: 50331 - protein, 111 aa, Artificial
  Synthetic
QSALTQPASVSGSPGQSITISCTGTSSDVGGYNYVSWYQQHPGKAPKLMIYEVSNRPSGVSNRFSGSKSGNTASLTISGLQAEDEADYYCNSYTRSITWVFGGGTKLTVLG

SEQ ID NO: 50332 - protein, 109 aa, Artificial
  Synthetic
DIQMTQSPSSLSASVGDRVTITCRASQSISNYLNWYQQKPGKAPKLLIYAASSLQSGVPSRFSGSGSGTDFTLTISSLQPEDFATYYCQQSYSTPTWTFGQGTKVEIKR

SEQ ID NO: 50333 - protein, 108 aa, Artificial
  Synthetic
DIQMTQSPSSVSASVGDRVTITCRASQGISSWLAWYQQKPGKAPKLLIYAASSLQSGVPSRFSGSGSGTDFTLTISSLQPEDFATYYCQQINSFPLTFGGGTKVEIKR

SEQ ID NO: 50334 - protein, 108 aa, Artificial
  Synthetic
DIQMTQSPSSLSASVGDRVTITCQASQDINNYLNWYQQKPGKAPKLLIYDASNLETGVPSRFSGSGSGTDFTFTISSLQPEDIATYYCQQYDNLPITFGQGTRLEIKR

SEQ ID NO: 50335 - protein, 111 aa, Artificial
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVGVFGGGTKLTVLG

SEQ ID NO: 50336 - protein, 113 aa, Artificial
  Synthetic
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALHPPLTFGGGTKVEIKR

SEQ ID NO: 50337 - protein, 111 aa, Artificial
  Synthetic
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVLG

SEQ ID NO: 50338 - protein, 111 aa, Artificial
  Synthetic
QSVLTQPPSASGTPGQRVTISCSGSSSNIGSNIVTWYQQLPGTAPKLLIYSNDQRPSGVPDRFSGSKSGTSASLAISGLQSEDEADYYCAAWDDSLNGWVFGGGTTLTVLG

SEQ ID NO: 50339 - protein, 108 aa, Artificial
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPITFGQGTRLEIKR

SEQ ID NO: 50340 - protein, 108 aa, Artificial
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSIPITFGQGTRLEIKR

SEQ ID NO: 50341 - protein, 113 aa, Artificial
  Synthetic
DIVMTQTPLSLSVTPGQPASISCKSSQSLLHSEGKTYLYWYLQKPGQPPQLLIYEVSNRFSGVPDRFSGSGSGTDFTLKISRVEAEDVGVYYCMQSIQLPITFGQGTRLEIKR

SEQ ID NO: 50342 - protein, 109 aa, Artificial
  Synthetic
EIVLTQSPGTLSLFPGERATLSCRASQSVISSYLAWYQQKPGQAPRLLIFGVSSRATGIPDRFSGSGSGTDFTLTISRLEPEDFAVYYCQQYGRSPFNFGPGTKVDIKR

SEQ ID NO: 50343 - protein, 108 aa, Artificial
  Synthetic
EIVMTQSPATLSVSPGERATLSCRASQSVSSNLAWYQQKPGQAPRLLIYGASTRATGIPARFSGSGSGTEFTLTISSLQSEDFAVYYCQQYNDWPWTFGQGTKVEIKR

SEQ ID NO: 50344 - protein, 108 aa, Artificial
  Synthetic
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPWTFGQGTKVEIKR

SEQ ID NO: 50345 - protein, 108 aa, Artificial
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHYSYPRSFGQGTKLEIKR

SEQ ID NO: 50346 - protein, 108 aa, Artificial
  Synthetic
DIQMTQSPSSLSASVGDRVTITCRASQGISNYLAWFQQKPGKAPKSLIYAASSLQSGVPSKFSGSGSGTDFTLTISSLQPEDFATYYCQQYLSYPITFGQGTRLEIKR

SEQ ID NO: 50347 - protein, 108 aa, Artificial
  Synthetic
EIVLTQSPDFQSVTPKEKVTITCRASQSIGSSLHWYQQKPDQSPKLLIKYASQSFSGVPSRFSGSGSGTDFTLTINSLEAEDAATYYCHQSRRLPLTFGGGTKVEIKR

SEQ ID NO: 50348 - protein, 110 aa, Artificial
  Synthetic
SSELTQDPAVSVALGQTVRITCQGDSLRPYYASWYQQKPGQAPVLVIYGKNNRPSGIPDRFSGSSSGNTASLTITGAQAEDEADYYCNSRDSSGNHLVVFGGGTKLTVLG

SEQ ID NO: 50349 - protein, 113 aa, Artificial
  Synthetic
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPLTFGGGTKVEIKR

SEQ ID NO: 50350 - protein, 108 aa, Artificial
  Synthetic
EIVMTQSPATLSVSPGERATLSCRASQSVSRNLAWYQQKPGQAPRLLIYGASTRATGIPARFSGSGSGTEFTLTISSLQSEDFAVYYCQQYNNWPLTFGGGTKVEIKR

SEQ ID NO: 50351 - protein, 107 aa, Artificial
  Synthetic
SYELTQPLSVSVALGQTARITCGGNNIGRKNVHWYQQKPGQAPVLVIYRDSDRPSGIPERFSGSNSGNTATLTISRAQAGDEADYYCQVWDSSTVVFGGGTKLTVLG

SEQ ID NO: 50352 - protein, 117 aa, Artificial
  Synthetic
QVQLVQSGAEVKKPGASVKVSCKASGYTFTDYYMHWVRQAPGQGLEWMGWINPNNGGTNYAQKFQGRVTMTRDTSISTAYMELSRLRSDDTAVYYCARDGTGSFDYWGQGTLVTVSS

SEQ ID NO: 50353 - protein, 124 aa, Artificial; identical to SEQ ID NO: 50288
  Synthetic

SEQ ID NO: 50354 - protein, 118 aa, Artificial; identical to SEQ ID NO: 29778
  Synthetic

SEQ ID NO: 50355 - protein, 115 aa, Artificial; identical to SEQ ID NO: 50279
  Synthetic

SEQ ID NO: 50356 - protein, 114 aa, Artificial; identical to SEQ ID NO: 28608
  Synthetic

SEQ ID NO: 50357 - protein, 115 aa, Artificial
  Synthetic
EVQLLESGGGLVQPGGSLRLSCAASGFTFSSYVMNWVRQAPGKGLEWVSAISGSGGSTYYADSVKGRFTISRDNSKNTLYLQMNSLRAEDTAVYYCARTGVFDYWGQGTLVTVSS

SEQ ID NO: 50358 - protein, 123 aa, Artificial; identical to SEQ ID NO: 29132
  Synthetic

SEQ ID NO: 50359 - protein, 121 aa, Artificial
  Synthetic
  MOD_RES (35)..(35): Any amino acid
EVQLLESGGGLVQPGGSLRLSCAASEFTFSSYAMXWVRQAPGKGLEWVSVISGRGGNTFYADSVKGRFTISRDNSKNTLYLQMNSLRAEDTAVYYCASRLAVAGSEAFDIWGQGTMVTVSS

SEQ ID NO: 50360 - protein, 118 aa, Artificial
  Synthetic
  MOD_RES (53)..(53): Any amino acid
QVQLVESGGGVVQPGRSLRLSCAASGFTFSSYGMHWVRQAPGKGLEWVAVIWXDGSNKYYADSVKGRFTISRDNSKNTLYLQMNSLRAEDTAVYYCARDLSMGGMDVWGQGTTVTVSS

SEQ ID NO: 50361 - protein, 123 aa, Artificial
  Synthetic
QVQLVESGGGVVQPGRSLRLSCAASGFTFSSYVMHWVRQAPGKGLEWVAVIWYDGSNKYYADSVKGRFTISRDNSKNTLYLQMNSLRAEDTAVYYCAREKYSSSWYDYGMDVWGQGTTVTVSS

SEQ ID NO: 50362 - protein, 117 aa, Artificial
  Synthetic
QVQLVESGGGVVQPGRSLRLSCAASGFTFSDYGMHWVRQAPGKGLEWVAVIWYDESNKYYADSVKGRFTISRDNSKNTLYLQMNSLRAEDTAVYYCAREIGWLDDYWGQGTLVTVSS

SEQ ID NO: 50363 - protein, 117 aa, Artificial
  Synthetic
QVQLVESGGGVVQPGRSLRLSCAASGFTFSDYGMHWVRQAPGKGLEWVAVIWYDENNKYYADSVKGRFTISRDNSKNTLYLQMNSLRAEDTAVYYCARELGFRSDYWGQGTLVTVSS

SEQ ID NO: 50364 - protein, 119 aa, Artificial; identical to SEQ ID NO: 50284
  Synthetic

SEQ ID NO: 50365 - protein, 119 aa, Artificial; identical to SEQ ID NO: 50294
  Synthetic

SEQ ID NO: 50366 - protein, 108 aa, Artificial; identical to SEQ ID NO: 50321
  Synthetic

SEQ ID NO: 50367 - protein, 109 aa, Artificial
  Synthetic
DSYELTQPPSVSVSPGQTASITCSGDKLGDKYAYWYQQKPGQSPVLVIYQDRKRPSGIPERFSGSNSGNTATLTISGTQAMDEADYYCQAWDNSTVVFGGGTKLTVLGG

SEQ ID NO: 50368 - protein, 114 aa, Artificial
  Synthetic
DIVMTQSPDSLAVSLGERATINCKSSQSVLYSSNNNNYLAWYQQKPGQPPKLLIYWASTRESGVPDRFSGSGSGTDFTLTISSLQAEDVAVYYCQQYYSTPPTFGQGTKVEIKR

SEQ ID NO: 50369 - protein, 108 aa, Artificial; identical to SEQ ID NO: 50320
  Synthetic

SEQ ID NO: 50370 - protein, 108 aa, Artificial
  Synthetic
DIQMTQSPSSLSASVGDRVTITCRASQGIRNNLGWYQQKPGKAPKRLIYAASSLQSGVPSRFSGSGSGTEFTLTISSLQPEDFATYYCLQYNSYPFTFGQGTKVEIKR

SEQ ID NO: 50371 - protein, 108 aa, Artificial
  Synthetic
DIQMTQSPSSLSASVGDRVTITCRASQGISNYLAWFQQKPGKAPKSLISAASSLQSGVPSKFSGSGSGTDFTLTISSLQPEDFATYYCQQYNSYPFTFGPGTKVDIKR

SEQ ID NO: 50372 - protein, 108 aa, Artificial
  Synthetic
DIQMTQSPSSLSASVGDRVTITCRASQDIRSDLGWYQQKPGKAPKRLIYAASSLQSGVPSRFSGSGSGTEFTLTISSLQPEDFATYYCLQHTIYPPTFGGGTKVEIKR

SEQ ID NO: 50373 - protein, 111 aa, Artificial
  Synthetic
  MOD_RES (3)..(3): Any amino acid
  MOD_RES (8)..(8): Any amino acid
  MOD_RES (10)..(10): Any amino acid
  MOD_RES (31)..(32): Any amino acid
  MOD_RES (34)..(34): Any amino acid
  MOD_RES (61)..(62): Any amino acid
  MOD_RES (82)..(82): Any amino acid
  MOD_RES (95)..(95): Any amino acid
  MOD_RES (97)..(97): Any amino acid
QSXLTQPXSXSGSPGQSITISCTGTSSDVGXXNXVSWYQQHPGKAPKLMIYEVSNRPSGVXXRFSGSKSGNTASLTISGLQXEDEADYYCSSYTXSXTVVFGGGTKLTVLG

SEQ ID NO: 50374 - protein, 109 aa, Artificial
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYRTPLFTFGPGTKVDIKR

SEQ ID NO: 50375 - protein, 108 aa, Artificial
  Synthetic
DIQMTQSPSSLSASVGDRVTITCRASQSIISYLNWYQQKPGKAPKLLIYTASSLQSGVPSRFSGSGSGTDFTLTISSLQPEDFATYYCQQTYSTPLTFGGGTKVEIKR

SEQ ID NO: 50376 - protein, 108 aa, Artificial; identical to SEQ ID NO: 50315
  Synthetic

SEQ ID NO: 50377 - protein, 108 aa, Artificial
  Synthetic
  MOD_RES (100)..(100): Any amino acid
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGXGTKVEIKR

SEQ ID NO: 50378 - protein, 108 aa, Artificial; identical to SEQ ID NO: 50312
  Synthetic

SEQ ID NO: 50379 - protein, 108 aa, Artificial
  Synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHSSYPLTFGGGTKVEIKR

SEQ ID NO: 50380 - protein, 108 aa, Artificial
  Synthetic
DIQMTQSPSSLSASVGDRVTITCRASQGIRNDLGWYQQKPGKAPKRLIYAASSVQSGVPSRFSGSGSGTEFTLTISSLQPEDFAIYYCLQHNSYPLTFGGGTKVEIKR

SEQ ID NO: 50381 - protein, 5 aa, Artificial
  Synthetic
DYYMH

SEQ ID NO: 50382 - protein, 17 aa, Artificial
  Synthetic
WINPNNGGTNYAQKFQG

SEQ ID NO: 50383 - protein, 8 aa, Artificial
  Synthetic
DGTGSFDY

SEQ ID NO: 50384 - protein, 5 aa, Artificial
  Synthetic
GYYMH

SEQ ID NO: 50385 - protein, 17 aa, Artificial
  Synthetic
WINPNSGGTNYAQKFQG

SEQ ID NO: 50386 - protein, 15 aa, Artificial
  Synthetic
SYYYGSGSYYNEFDY

SEQ ID NO: 50387 - protein, 5 aa, Artificial
  Synthetic
NYDIN

SEQ ID NO: 50388 - protein, 17 aa, Artificial
  Synthetic
WMHPNSGNTGYAQKFQG

SEQ ID NO: 50389 - protein, 9 aa, Artificial
  Synthetic
SSGWYYFDY

SEQ ID NO: 50390 - protein, 5 aa, Artificial
  Synthetic
SYSMN

SEQ ID NO: 50391 - protein, 17 aa, Artificial
  Synthetic
SISGSSSYIYYADSVKG

SEQ ID NO: 50392 - protein, 6 aa, Artificial
  Synthetic
VASFDY

SEQ ID NO: 50393 - protein, 5 aa, Artificial
  Synthetic
SYSMN

SEQ ID NO: 50394 - protein, 17 aa, Artificial
  Synthetic
SISGSSSYIYYADSVKG

SEQ ID NO: 50395 - protein, 5 aa, Artificial
  Synthetic
DRGSL

SEQ ID NO: 50396 - protein, 5 aa, Artificial
  Synthetic
SYVMN

SEQ ID NO: 50397 - protein, 17 aa, Artificial
  Synthetic
AISGSGGSTYYADSVKG

SEQ ID NO: 50398 - protein, 6 aa, Artificial
  Synthetic
TGVFDY

SEQ ID NO: 50399 - protein, 5 aa, Artificial
  Synthetic
SYAMS

SEQ ID NO: 50400 - protein, 17 aa, Artificial
  Synthetic
AISGRGGSTFHADSVKG

SEQ ID NO: 50401 - protein, 14 aa, Artificial
  Synthetic
GELLEDYYFYGMDV

SEQ ID NO: 50402 - protein, 5 aa, Artificial
  Synthetic
  MOD_RES (5)..(5): Any amino acid
SYAMX

SEQ ID NO: 50403 - protein, 17 aa, Artificial
  Synthetic
VISGRGGNTFYADSVKG

SEQ ID NO: 50404 - protein, 12 aa, Artificial
  Synthetic
RLAVAGSEAFDI

SEQ ID NO: 50405 - protein, 5 aa, Artificial
  Synthetic
SYGMH

SEQ ID NO: 50406 - protein, 17 aa, Artificial
  Synthetic
  MOD_RES (4)..(4): Any amino acid
VIWXDGSNKYYADSVKG

SEQ ID NO: 50407 - protein, 9 aa, Artificial
  Synthetic
DLSMGGMDV

SEQ ID NO: 50408 - protein, 5 aa, Artificial
  Synthetic
SYVMH

SEQ ID NO: 50409 - protein, 17 aa, Artificial
  Synthetic
VIWYDGSNKYYADSVKG

SEQ ID NO: 50410 - protein, 14 aa, Artificial
  Synthetic
EKYSSSWYDYGMDV

SEQ ID NO: 50411 - protein, 5 aa, Artificial
  Synthetic
DYGMH

SEQ ID NO: 50412 - protein, 17 aa, Artificial
  Synthetic
VIWYDESNKYYADSVKG

SEQ ID NO: 50413 - protein, 8 aa, Artificial
  Synthetic
EIGWLDDY

SEQ ID NO: 50414 - protein, 5 aa, Artificial
  Synthetic
DYGMH

SEQ ID NO: 50415 - protein, 17 aa, Artificial
  Synthetic
VIWYDENNKYYADSVKG

SEQ ID NO: 50416 - protein, 8 aa, Artificial
  Synthetic
ELGFRSDY

SEQ ID NO: 50417 - protein, 7 aa, Artificial
  Synthetic
RSSYYWG

SEQ ID NO: 50418 - protein, 16 aa, Artificial
  Synthetic
NIYYSGSTYYNPSLKS

SEQ ID NO: 50419 - protein, 9 aa, Artificial
  Synthetic
HSSSWSLDY

SEQ ID NO: 50420 - protein, 7 aa, Artificial
  Synthetic
RSSYYWG

SEQ ID NO: 50421 - protein, 16 aa, Artificial
  Synthetic
NIYYSGSTYYNPSLKS

SEQ ID NO: 50422 - protein, 9 aa, Artificial
  Synthetic
HGKDWGLDY

SEQ ID NO: 50423 - protein, 11 aa, Artificial
  Synthetic
RASQGISRWLA

SEQ ID NO: 50424 - protein, 7 aa, Artificial
  Synthetic
AASSLQS

SEQ ID NO: 50425 - protein, 9 aa, Artificial
  Synthetic
QQANSFPFT

SEQ ID NO: 50426 - protein, 11 aa, Artificial
  Synthetic
SGDKLGDKYAY

SEQ ID NO: 50427 - protein, 7 aa, Artificial
  Synthetic
QDRKRPS

SEQ ID NO: 50428 - protein, 9 aa, Artificial
  Synthetic
QAWDNSTVV

SEQ ID NO: 50429 - protein, 17 aa, Artificial
  Synthetic
KSSQSVLYSSNNNNYLA

SEQ ID NO: 50430 - protein, 7 aa, Artificial
  Synthetic
WASTRES

SEQ ID NO: 50431 - protein, 9 aa, Artificial
  Synthetic
QQYYSTPPT

SEQ ID NO: 50432 - protein, 11 aa, Artificial
  Synthetic
RASQGISNYLA

SEQ ID NO: 50433 - protein, 7 aa, Artificial
  Synthetic
AASSLQS

SEQ ID NO: 50434 - protein, 9 aa, Artificial
  Synthetic
QQYNSYPFT

SEQ ID NO: 50435 - protein, 11 aa, Artificial
  Synthetic
RASQGIRNNLG

SEQ ID NO: 50436 - protein, 7 aa, Artificial
  Synthetic
AASSLQS

SEQ ID NO: 50437 - protein, 9 aa, Artificial
  Synthetic
LQYNSYPFT

SEQ ID NO: 50438 - protein, 11 aa, Artificial
  Synthetic
RASQGISNYLA

SEQ ID NO: 50439 - protein, 7 aa, Artificial
  Synthetic
AASSLQS

SEQ ID NO: 50440 - protein, 9 aa, Artificial
  Synthetic
QQYNSYPFT

SEQ ID NO: 50441 - protein, 11 aa, Artificial
  Synthetic
RASQDIRSDLG

SEQ ID NO: 50442 - protein, 7 aa, Artificial
  Synthetic
AASSLQS

SEQ ID NO: 50443 - protein, 9 aa, Artificial
  Synthetic
LQHTIYPPT

SEQ ID NO: 50444 - protein, 14 aa, Artificial
  Synthetic
  MOD_RES (9)..(10): Any amino acid
  MOD_RES (12)..(12): Any amino acid
TGTSSDVGXXNXVS

SEQ ID NO: 50445 - protein, 7 aa, Artificial
  Synthetic
EVSNRPS

SEQ ID NO: 50446 - protein, 10 aa, Artificial
  Synthetic
  MOD_RES (5)..(5): Any amino acid
  MOD_RES (7)..(7): Any amino acid
SSYTXSXTVV

SEQ ID NO: 50447 - protein, 11 aa, Artificial
  Synthetic
RASQSISSYLN

SEQ ID NO: 50448 - protein, 7 aa, Artificial
  Synthetic
AASSLQS

SEQ ID NO: 50449 - protein, 10 aa, Artificial
  Synthetic
QQSYRTPLFT

SEQ ID NO: 50450 - protein, 11 aa, Artificial
  Synthetic
RASQSIISYLN

SEQ ID NO: 50451 - protein, 7 aa, Artificial
  Synthetic
TASSLQS

SEQ ID NO: 50452 - protein, 9 aa, Artificial
  Synthetic
QQTYSTPLT

SEQ ID NO: 50453 - protein, 11 aa, Artificial
  Synthetic
RASQGIRNDLG

SEQ ID NO: 50454 - protein, 7 aa, Artificial
  Synthetic
AASSLQS

SEQ ID NO: 50455 - protein, 9 aa, Artificial
  Synthetic
LQHYSYPRT

SEQ ID NO: 50456 - protein, 11 aa, Artificial
  Synthetic
RASQGIRNDLG

SEQ ID NO: 50457 - protein, 7 aa, Artificial
  Synthetic
AASSLQS

SEQ ID NO: 50458 - protein, 9 aa, Artificial
  Synthetic
LQHNSYPFT

SEQ ID NO: 50459 - protein, 11 aa, Artificial
  Synthetic
RASQGIRNDLG

SEQ ID NO: 50460 - protein, 7 aa, Artificial
  Synthetic
AASSLQS

SEQ ID NO: 50461 - protein, 9 aa, Artificial
  Synthetic
LQHNSYPLT

SEQ ID NO: 50462 - protein, 11 aa, Artificial
  Synthetic
RASQGIRNDLG

SEQ ID NO: 50463 - protein, 7 aa, Artificial
  Synthetic
AASSLQS

SEQ ID NO: 50464 - protein, 9 aa, Artificial
  Synthetic
LQHSSYPLT

SEQ ID NO: 50465 - protein, 11 aa, Artificial
  Synthetic
RASQGIRNDLG

SEQ ID NO: 50466 - protein, 7 aa, Artificial
  Synthetic
AASSVQS

SEQ ID NO: 50467 - protein, 9 aa, Artificial
  Synthetic
LQHNSYPLT

SEQ ID NO: 50468 - protein, 5 aa, Artificial
  Synthetic
NYDIN

SEQ ID NO: 50469 - protein, 17 aa, Artificial
  Synthetic
WMHPNSGNTGYAQKFQG

SEQ ID NO: 50470 - protein, 9 aa, Artificial
  Synthetic
SSGWYYFDY

SEQ ID NO: 50471 - protein, 5 aa, Artificial
  Synthetic
SYVMH

SEQ ID NO: 50472 - protein, 17 aa, Artificial
  Synthetic
VIWYDGSNKYYADSVKG

SEQ ID NO: 50473 - protein, 14 aa, Artificial
  Synthetic
ERYSSGWYDYGMDV

SEQ ID NO: 50474 - protein, 5 aa, Artificial
  Synthetic
DYGMH

SEQ ID NO: 50475 - protein, 17 aa, Artificial
  Synthetic
VIWYDENNKYYADSVKG

SEQ ID NO: 50476 - protein, 7 aa, Artificial
  Synthetic
ELGFSDY

SEQ ID NO: 50477 - protein, 5 aa, Artificial
  Synthetic
GCYWS

SEQ ID NO: 50478 - protein, 16 aa, Artificial
  Synthetic
EINHSGSTNYNPSLKS

SEQ ID NO: 50479 - protein, 7 aa, Artificial
  Synthetic
DYGGMDV

SEQ ID NO: 50480 - protein, 5 aa, Artificial
  Synthetic
NYDIN

SEQ ID NO: 50481 - protein, 17 aa, Artificial
  Synthetic
WMHPNSGNTGYAQKFQG

SEQ ID NO: 50482 - protein, 9 aa, Artificial
  Synthetic
SSGWYWFDP

SEQ ID NO: 50483 - protein, 5 aa, Artificial
  Synthetic
SYGMH

SEQ ID NO: 50484 - protein, 17 aa, Artificial
  Synthetic
VIWYDGSNKNYADSVKG

SEQ ID NO: 50485 - protein, 11 aa, Artificial
  Synthetic
DQGVGYYGLDV

SEQ ID NO: 50486 - protein, 5 aa, Artificial
  Synthetic
GYYMH

SEQ ID NO: 50487 - protein, 17 aa, Artificial
  Synthetic
WINPNSGGTNYAQKFQG

SEQ ID NO: 50488 - protein, 8 aa, Artificial
  Synthetic
DGTSSFDY

SEQ ID NO: 50489 - protein, 5 aa, Artificial
  Synthetic
SYGMH

SEQ ID NO: 50490 - protein, 17 aa, Artificial
  Synthetic
VIWHDGSNKYYADSVKG

SEQ ID NO: 50491 - protein, 9 aa, Artificial
  Synthetic
DLSMGGMDV

SEQ ID NO: 50492 - protein, 5 aa, Artificial
  Synthetic
DYGMH

SEQ ID NO: 50493 - protein, 17 aa, Artificial
  Synthetic
VIWYDESNKYYADSVKG

SEQ ID NO: 50494 - protein, 8 aa, Artificial
  Synthetic
EVGWLDDY

SEQ ID NO: 50495 - protein, 5 aa, Artificial
  Synthetic
SYSMN

SEQ ID NO: 50496 - protein, 17 aa, Artificial
  Synthetic
SISGSSSYIYYADSVKG

SEQ ID NO: 50497 - protein, 5 aa, Artificial
  Synthetic
DRGSS

SEQ ID NO: 50498 - protein, 5 aa, Artificial
  Synthetic
SYAMS

SEQ ID NO: 50499 - protein, 17 aa, Artificial
  Synthetic
VISGRGGNTFYADSVKG

SEQ ID NO: 50500 - protein, 12 aa, Artificial
  Synthetic
RIAVAGSEAFDI

SEQ ID NO: 50501 - protein, 5 aa, Artificial
  Synthetic
SYAMS

SEQ ID NO: 50502 - protein, 17 aa, Artificial
  Synthetic
AISGRGGSTFHADSVKG

SEQ ID NO: 50503 - protein, 14 aa, Artificial
  Synthetic
GELLEDYYFYGMDV

SEQ ID NO: 50504 - protein, 5 aa, Artificial
  Synthetic
SYGMH

SEQ ID NO: 50505 - protein, 17 aa, Artificial
  Synthetic
VIWYDGSNKYYADSVKG

SEQ ID NO: 50506 - protein, 20 aa, Artificial
  Synthetic
DRVYCSSTSCPYYYYYGMDV

SEQ ID NO: 50507 - protein, 5 aa, Artificial
  Synthetic
SYSMN

SEQ ID NO: 50508 - protein, 17 aa, Artificial
  Synthetic
SISGSSSYIYYADSVKG

SEQ ID NO: 50509 - protein, 6 aa, Artificial
  Synthetic
VASFDY

SEQ ID NO: 50510 - protein, 7 aa, Artificial
  Synthetic
SGDYYWN

SEQ ID NO: 50511 - protein, 16 aa, Artificial
  Synthetic
YIFYSGSTYYNPSLKS

SEQ ID NO: 50512 - protein, 17 aa, Artificial
  Synthetic
GDYDGSGSYHYYYGMDV

SEQ ID NO: 50513 - protein, 5 aa, Artificial
  Synthetic
SYAMS

SEQ ID NO: 50514 - protein, 17 aa, Artificial
  Synthetic
VISGGGSSTYYADSVKG

SEQ ID NO: 50515 - protein, 11 aa, Artificial
  Synthetic
WRGNPTDYGMD

SEQ ID NO: 50516 - protein, 5 aa, Artificial
  Synthetic
SYGMH

SEQ ID NO: 50517 - protein, 17 aa, Artificial
  Synthetic
IIWYDGSNKYYADSVKG

SEQ ID NO: 50518 - protein, 12 aa, Artificial
  Synthetic
DHYDFWSGHFDY

SEQ ID NO: 50519 - protein, 5 aa, Artificial
  Synthetic
GYYWS

SEQ ID NO: 50520 - protein, 16 aa, Artificial
  Synthetic
EINHSGRTNYNPSLKS

SEQ ID NO: 50521 - protein, 7 aa, Artificial
  Synthetic
DYGGLDY

SEQ ID NO: 50522 - protein, 7 aa, Artificial
  Synthetic
RSSYYWG

SEQ ID NO: 50523 - protein, 16 aa, Artificial
  Synthetic
NIYYSGSTYYNPSLKS

SEQ ID NO: 50524 - protein, 9 aa, Artificial
  Synthetic
HSSSWSLDY

SEQ ID NO: 50525 - protein, 5 aa, Artificial
  Synthetic
GYYIH

SEQ ID NO: 50526 - protein, 17 aa, Artificial
  Synthetic
WINPNSGGTNYAQKFQG

SEQ ID NO: 50527 - protein, 11 aa, Artificial
  Synthetic
GYSYGYNWFDP

SEQ ID NO: 50528 - protein, 5 aa, Artificial
  Synthetic
HYGMH

SEQ ID NO: 50529 - protein, 17 aa, Artificial
  Synthetic
VIWYDGSNKYYADSVKG

SEQ ID NO: 50530 - protein, 10 aa, Artificial
  Synthetic
GDWNPEGMDV

SEQ ID NO: 50531 - protein, 5 aa, Artificial
  Synthetic
SYAMS

SEQ ID NO: 50532 - protein, 17 aa, Artificial
  Synthetic
AISGSGGNTFYADSVKG

SEQ ID NO: 50533 - protein, 14 aa, Artificial
  Synthetic
KDYDYVWGSPYFDY

SEQ ID NO: 50534 - protein, 5 aa, Artificial
  Synthetic
GYYMH

SEQ ID NO: 50535 - protein, 17 aa, Artificial
  Synthetic
WINPNSGGTNYAQKFQG

SEQ ID NO: 50536 - protein, 15 aa, Artificial
  Synthetic
SYYYGSGSYYNEFDY

SEQ ID NO: 50537 - protein, 5 aa, Artificial
  Synthetic
GYYIH

SEQ ID NO: 50538 - protein, 17 aa, Artificial
  Synthetic
WINPYSGDTNYAQKFQG

SEQ ID NO: 50539 - protein, 14 aa, Artificial
  Synthetic
DWGGYSSYYYGMDV

SEQ ID NO: 50540 - protein, 5 aa, Artificial
  Synthetic
SYSMN

SEQ ID NO: 50541 - protein, 17 aa, Artificial
  Synthetic
SISGSSSYIYYADSVKG

SEQ ID NO: 50542 - protein, 5 aa, Artificial
  Synthetic
LTFDY

SEQ ID NO: 50543 - protein, 5 aa, Artificial
  Synthetic
TYGMH

SEQ ID NO: 50544 - protein, 17 aa, Artificial
  Synthetic
IIWYDGTNKYYADSVKG

SEQ ID NO: 50545 - protein, 13 aa, Artificial
  Synthetic
DPLRGYNDPVMDY

SEQ ID NO: 50546 - protein, 5 aa, Artificial
  Synthetic
SYAMS

SEQ ID NO: 50547 - protein, 17 aa, Artificial
  Synthetic
AISGRGGNTFYADSVKG

SEQ ID NO: 50548 - protein, 13 aa, Artificial
  Synthetic
RVTDYGGNDWFDP

SEQ ID NO: 50549 - protein, 5 aa, Artificial
  Synthetic
TYGMH

SEQ ID NO: 50550 - protein, 17 aa, Artificial
  Synthetic
VIWYGGSNKDYADSVKG

SEQ ID NO: 50551 - protein, 20 aa, Artificial
  Synthetic
DRDYCSGGSCPYYYYYGMDV

SEQ ID NO: 50552 - protein, 7 aa, Artificial
  Synthetic
RSSYYWG

SEQ ID NO: 50553 - protein, 16 aa, Artificial
  Synthetic
NIYYSGSTYYNPSLKS

SEQ ID NO: 50554 - protein, 9 aa, Artificial
  Synthetic
HGKDWGLDY

SEQ ID NO: 50555 - protein, 5 aa, Artificial
  Synthetic
GYYMH

SEQ ID NO: 50556 - protein, 17 aa, Artificial
  Synthetic
WIKPNSGGTNQAQKFQG

SEQ ID NO: 50557 - protein, 15 aa, Artificial
  Synthetic
APGTAAAGTWGYFDY

SEQ ID NO: 50558 - protein, 7 aa, Artificial
  Synthetic
TGGVGVG

SEQ ID NO: 50559 - protein, 16 aa, Artificial
  Synthetic
LIYWDDDKRYSPSLKS

SEQ ID NO: 50560 - protein, 8 aa, Artificial
  Synthetic
LIAVAFDY

SEQ ID NO: 50561 - protein, 5 aa, Artificial
  Synthetic
SYGMH

SEQ ID NO: 50562 - protein, 17 aa, Artificial
  Synthetic
IIWYDGSYKYYADSVKG

SEQ ID NO: 50563 - protein, 12 aa, Artificial
  Synthetic
EAYDFWSGYFDY

SEQ ID NO: 50564 - protein, 5 aa, Artificial
  Synthetic
SYGMH

SEQ ID NO: 50565 - protein, 17 aa, Artificial
  Synthetic
VIWYDGSNKYYADSVKG

SEQ ID NO: 50566 - protein, 11 aa, Artificial
  Synthetic
DRDYGDYGMDV

SEQ ID NO: 50567 - protein, 5 aa, Artificial
  Synthetic
SYAMS

SEQ ID NO: 50568 - protein, 17 aa, Artificial
  Synthetic
AISGSGGNTFYADSVKG

SEQ ID NO: 50569 - protein, 12 aa, Artificial
  Synthetic
LGKDYYYYGMDV

SEQ ID NO: 50570 - protein, 5 aa, Artificial
  Synthetic
SYVMS

SEQ ID NO: 50571 - protein, 17 aa, Artificial
  Synthetic
AMSGSGGRTYYADSVKG

SEQ ID NO: 50572 - protein, 6 aa, Artificial
  Synthetic
LTAFDY

SEQ ID NO: 50573 - protein, 5 aa, Artificial
  Synthetic
SYGMH

SEQ ID NO: 50574 - protein, 17 aa, Artificial
  Synthetic
IISYAGSNKYYADSVKG

SEQ ID NO: 50575 - protein, 12 aa, Artificial
  Synthetic
RGYSYGGYGMDV

SEQ ID NO: 50576 - protein, 5 aa, Artificial
  Synthetic
DYVMH

SEQ ID NO: 50577 - protein, 17 aa, Artificial
  Synthetic
VIWYDGSNKYYADSVKG

SEQ ID NO: 50578 - protein, 14 aa, Artificial
  Synthetic
EPYTSGWYDYGMDV

SEQ ID NO: 50579 - protein, 5 aa, Artificial
  Synthetic
SYGIS

SEQ ID NO: 50580 - protein, 17 aa, Artificial
  Synthetic
WISAYNGNTKYAQKLQG

SEQ ID NO: 50581 - protein, 13 aa, Artificial
  Synthetic
HDFWSGYYKGMDV

SEQ ID NO: 50582 - protein, 5 aa, Artificial
  Synthetic
SYAMS

SEQ ID NO: 50583 - protein, 17 aa, Artificial
  Synthetic
AISGRGGNTFDADSVKG

SEQ ID NO: 50584 - protein, 9 aa, Artificial
  Synthetic
ERSGSYFDY

SEQ ID NO: 50585 - protein, 5 aa, Artificial
  Synthetic
NYGMH

SEQ ID NO: 50586 - protein, 17 aa, Artificial
  Synthetic
VIWHDGSNKYYADSVKG

SEQ ID NO: 50587 - protein, 21 aa, Artificial
  Synthetic
ENSSSYYFDYWGQGTLVTVSS

SEQ ID NO: 50588 - protein, 7 aa, Artificial
  Synthetic
TSGVGVG

SEQ ID NO: 50589 - protein, 16 aa, Artificial
  Synthetic
LINWNDDKRYSPSLKS

SEQ ID NO: 50590 - protein, 9 aa, Artificial
  Synthetic
KATWVAFDI

SEQ ID NO: 50591 - protein, 5 aa, Artificial
  Synthetic
SYVMN

SEQ ID NO: 50592 - protein, 17 aa, Artificial
  Synthetic
AISGSGGRTYYADSVKG

SEQ ID NO: 50593 - protein, 6 aa, Artificial
  Synthetic
TATFDY

SEQ ID NO: 50594 - protein, 5 aa, Artificial
  Synthetic
SYAMS

SEQ ID NO: 50595 - protein, 17 aa, Artificial
  Synthetic
VISGRGGTTFYADSVKG

SEQ ID NO: 50596 - protein, 10 aa, Artificial
  Synthetic
KRTPSDVFDI

SEQ ID NO: 50597 - protein, 5 aa, Artificial
  Synthetic
SYGMH

SEQ ID NO: 50598 - protein, 17 aa, Artificial
  Synthetic
VIWYDGSNKYYADSVKG

SEQ ID NO: 50599 - protein, 10 aa, Artificial
  Synthetic
DRPRSSAFDY

SEQ ID NO: 50600 - protein, 5 aa, Artificial
  Synthetic
SYNMN

SEQ ID NO: 50601 - protein, 17 aa, Artificial
  Synthetic
YISRSSNTKYYADSVKG

SEQ ID NO: 50602 - protein, 16 aa, Artificial
  Synthetic
DRSGSYGYFYYYGLDV

SEQ ID NO: 50603 - protein, 7 aa, Artificial
  Synthetic
SGGDYWS

SEQ ID NO: 50604 - protein, 16 aa, Artificial
  Synthetic
YIYYSGSTYYNPSLKS

SEQ ID NO: 50605 - protein, 9 aa, Artificial
  Synthetic
DSSSYGMDV

SEQ ID NO: 50606 - protein, 11 aa, Artificial
  Synthetic
RASQGIRNDLG

SEQ ID NO: 50607 - protein, 7 aa, Artificial
  Synthetic
AASSLQS

SEQ ID NO: 50608 - protein, 9 aa, Artificial
  Synthetic
LQHNSYPLT

SEQ ID NO: 50609 - protein, 11 aa, Artificial
  Synthetic
SGDKLGDKYAC

SEQ ID NO: 50610 - protein, 7 aa, Artificial
  Synthetic
QDRKRPS

SEQ ID NO: 50611 - protein, 9 aa, Artificial
  Synthetic
QAWDSSTVV

SEQ ID NO: 50612 - protein, 12 aa, Artificial
  Synthetic
RASQSVYSSYLA

SEQ ID NO: 50613 - protein, 7 aa, Artificial
  Synthetic
GASSRAT

SEQ ID NO: 50614 - protein, 9 aa, Artificial
  Synthetic
QQYDNSPWT

SEQ ID NO: 50615 - protein, 11 aa, Artificial
  Synthetic
RASQGIRNDLG

SEQ ID NO: 50616 - protein, 7 aa, Artificial
  Synthetic
AASSLQS

SEQ ID NO: 50617 - protein, 9 aa, Artificial
  Synthetic
LQHYSYPRT

SEQ ID NO: 50618 - protein, 17 aa, Artificial
  Synthetic
KSSQSVLHSSNNNNYLA

SEQ ID NO: 50619 - protein, 7 aa, Artificial
  Synthetic
WASTRES

SEQ ID NO: 50620 - protein, 9 aa, Artificial
  Synthetic
QQYYSTPPT

SEQ ID NO: 50621 - protein, 11 aa, Artificial
  Synthetic
RASQGIRNDLG

SEQ ID NO: 50622 - protein, 7 aa, Artificial
  Synthetic
AASSLQS

SEQ ID NO: 50623 - protein, 9 aa, Artificial
  Synthetic
LQHNSYPFT

SEQ ID NO: 50624 - protein, 11 aa, Artificial
  Synthetic
RASQGISNYLA

SEQ ID NO: 50625 - protein, 7 aa, Artificial
  Sythetic
AASSLQS

SEQ ID NO: 50626 - protein, 9 aa, Artificial
  Synthetic
QQYSTYPLT

SEQ ID NO: 50627 - protein, 11 aa, Artificial
  Synthetic
RASQNIISYLN

SEQ ID NO: 50628 - protein, 7 aa, Artificial
  Synthetic
TASSLQS

SEQ ID NO: 50629 - protein, 9 aa, Artificial
  Synthetic
QQSYSTPLT

SEQ ID NO: 50630 - protein, 11 aa, Artificial
  Synthetic
RASQGISNYLA

SEQ ID NO: 50631 - protein, 7 aa, Artificial
  Synthetic
AASSLQS

SEQ ID NO: 50632 - protein, 9 aa, Artificial
  Synthetic
QQYNSYPFT

SEQ ID NO: 50633 - protein, 11 aa, Artificial
  Synthetic
RASQGISRWLA

SEQ ID NO: 50634 - protein, 7 aa, Artificial
  Synthetic
AASSLQS

SEQ ID NO: 50635 - protein, 9 aa, Artificial
  Synthetic
QQANSFPFT

SEQ ID NO: 50636 - protein, 16 aa, Artificial
  Synthetic
KSSQSLLHGDGKTYLY

SEQ ID NO: 50637 - protein, 7 aa, Artificial
  Synthetic
EVSNRFS

SEQ ID NO: 50638 - protein, 9 aa, Artificial
  Synthetic
MQSIQLPWT

SEQ ID NO: 50639 - protein, 11 aa, Artificial
  Synthetic
RASQSISSYLN

SEQ ID NO: 50640 - protein, 7 aa, Artificial
  Synthetic
AASSLQS

SEQ ID NO: 50641 - protein, 9 aa, Artificial
  Synthetic
QQSYSPPFT

SEQ ID NO: 50642 - protein, 17 aa, Artificial
  Synthetic
KSSQSVLYSSNNNNYLA

SEQ ID NO: 50643 - protein, 7 aa, Artificial
  Synthetic
WASTRES

SEQ ID NO: 50644 - protein, 9 aa, Artificial
  Synthetic
QQYYSTPCS

SEQ ID NO: 50645 - protein, 11 aa, Artificial
  Synthetic
RASQGISNWLA

SEQ ID NO: 50646 - protein, 7 aa, Artificial
  Synthetic
AASSLQS

SEQ ID NO: 50647 - protein, 9 aa, Artificial
  Synthetic
QQANSFPWT

SEQ ID NO: 50648 - protein, 17 aa, Artificial
  Synthetic
KSSQSVLHSSNNNNYLA

SEQ ID NO: 50649 - protein, 7 aa, Artificial
  Synthetic
WASTRES

SEQ ID NO: 50650 - protein, 9 aa, Artificial
  Synthetic
QQYYSTPVT

SEQ ID NO: 50651 - protein, 14 aa, Artificial
  Synthetic
ASSTGAVTSGYYPN

SEQ ID NO: 50652 - protein, 7 aa, Artificial
  Synthetic
STSNKHS

SEQ ID NO: 50653 - protein, 10 aa, Artificial
  Synthetic
LLYYGGAQLV

SEQ ID NO: 50654 - protein, 11 aa, Artificial
  Synthetic
RASQSVNSNLA

SEQ ID NO: 50655 - protein, 7 aa, Artificial
  Synthetic
GASTRAT

SEQ ID NO: 50656 - protein, 9 aa, Artificial
  Synthetic
QQYNDWPCS

SEQ ID NO: 50657 - protein, 12 aa, Artificial
  Synthetic
RASQSVSSSYLV

SEQ ID NO: 50658 - protein, 7 aa, Artificial
  Synthetic
GASTRAT

SEQ ID NO: 50659 - protein, 9 aa, Artificial
  Synthetic
QQYGCSPLT

SEQ ID NO: 50660 - protein, 16 aa, Artificial
  Synthetic
KSSQSLLHSEGKTYLY

SEQ ID NO: 50661 - protein, 7 aa, Artificial
  Synthetic
EVSNRFS

SEQ ID NO: 50662 - protein, 9 aa, Artificial
  Synthetic
MQSIQLPLT

SEQ ID NO: 50663 - protein, 14 aa, Artificial
  Synthetic
TGTSSDVGGYNYVS

SEQ ID NO: 50664 - protein, 7 aa, Artificial
  Synthetic
EVSNRPS

SEQ ID NO: 50665 - protein, 10 aa, Artificial
  Synthetic
NSYTRSITWV

SEQ ID NO: 50666 - protein, 11 aa, Artificial
  Synthetic
RASQSISNYLN

SEQ ID NO: 50667 - protein, 7 aa, Artificial
  Synthetic
AASSLQS

SEQ ID NO: 50668 - protein, 10 aa, Artificial
  Synthetic
QQSYSTPTWT

SEQ ID NO: 50669 - protein, 11 aa, Artificial
  Synthetic
RASQGISSWLA

SEQ ID NO: 50670 - protein, 7 aa, Artificial
  Synthetic
AASSLQS

SEQ ID NO: 50671 - protein, 9 aa, Artificial
  Synthetic
QQINSFPLT

SEQ ID NO: 50672 - protein, 11 aa, Artificial
  Synthetic
QASQDINNYLN

SEQ ID NO: 50673 - protein, 7 aa, Artificial
  Synthetic
DASNLET

SEQ ID NO: 50674 - protein, 9 aa, Artificial
  Synthetic
QQYDNLPIT

SEQ ID NO: 50675 - protein, 13 aa, Artificial
  Synthetic
SGSSSNIGNNYVS

SEQ ID NO: 50676 - protein, 7 aa, Artificial
  Synthetic
DNNKRPS

SEQ ID NO: 50677 - protein, 11 aa, Artificial
  Synthetic
GTWDSSLSVGV

SEQ ID NO: 50678 - protein, 16 aa, Artificial
  Synthetic
RSSQSLLHSNGYNYLD

SEQ ID NO: 50679 - protein, 7 aa, Artificial
  Synthetic
LGSNRAS

SEQ ID NO: 50680 - protein, 9 aa, Artificial
  Synthetic
MQALHPPLT

SEQ ID NO: 50681 - protein, 13 aa, Artificial
  Synthetic
SGSSSNIGSNTVN

SEQ ID NO: 50682 - protein, 7 aa, Artificial
  Synthetic
SNNQRPS

SEQ ID NO: 50683 - protein, 11 aa, Artificial
  Synthetic
AAWDDSLNGVV

SEQ ID NO: 50684 - protein, 13 aa, Artificial
  Synthetic
SGSSSNIGSNIVT

SEQ ID NO: 50685 - protein, 7 aa, Artificial
  Synthetic
SNDQRPS

SEQ ID NO: 50686 - protein, 11 aa, Artificial
  Synthetic
AAWDDSLNGWV

SEQ ID NO: 50687 - protein, 11 aa, Artificial
  Synthetic
RASQGIRNDLG

SEQ ID NO: 50688 - protein, 7 aa, Artificial
  Synthetic
AASSLQS

SEQ ID NO: 50689 - protein, 9 aa, Artificial
  Synthetic
LQHNSYPIT

SEQ ID NO: 50690 - protein, 11 aa, Artificial
  Synthetic
RASQSISSYLN

SEQ ID NO: 50691 - protein, 7 aa, Artificial
  Synthetic
AASSLQS

SEQ ID NO: 50692 - protein, 9 aa, Artificial
  Synthetic
QQSYSIPIT

SEQ ID NO: 50693 - protein, 16 aa, Artificial
  Synthetic
KSSQSLLHSEGKTYLY

SEQ ID NO: 50694 - protein, 7 aa, Artificial
  Synthetic
EVSNRFS

SEQ ID NO: 50695 - protein, 9 aa, Artificial
  Synthetic
MQSIQLPIT

SEQ ID NO: 50696 - protein, 12 aa, Artificial
  Synthetic
RASQSVISSYLA

SEQ ID NO: 50697 - protein, 7 aa, Artificial
  Synthetic
GVSSRAT

SEQ ID NO: 50698 - protein, 9 aa, Artificial
  Synthetic
QQYGRSPFN

SEQ ID NO: 50699 - protein, 11 aa, Artificial
  Synthetic
RASQSVSSNLA

SEQ ID NO: 50700 - protein, 7 aa, Artificial
  Synthetic
GASTRAT

SEQ ID NO: 50701 - protein, 9 aa, Artificial
  Synthetic
QQYNDWPWT

SEQ ID NO: 50702 - protein, 11 aa, Artificial
  Synthetic
RASQSIGSSLH

SEQ ID NO: 50703 - protein, 7 aa, Artificial
  Synthetic
YASQSFS

SEQ ID NO: 50704 - protein, 9 aa, Artificial
  Synthetic
HQSSSLPWT

SEQ ID NO: 50705 - protein, 11 aa, Artificial
  Synthetic
RASQGIRNDLG

SEQ ID NO: 50706 - protein, 7 aa, Artificial
  Synthetic
AASSLQS

SEQ ID NO: 50707 - protein, 9 aa, Artificial
  Synthetic
LQHYSYPRS

SEQ ID NO: 50708 - protein, 11 aa, Artificial
  Synthetic
RASQGISNYLA

SEQ ID NO: 50709 - protein, 7 aa, Artificial
  Synthetic
AASSLQS

SEQ ID NO: 50710 - protein, 9 aa, Artificial
  Synthetic
QQYLSYPIT

SEQ ID NO: 50711 - protein, 11 aa, Artificial
  Synthetic
RASQSIGSSLH

SEQ ID NO: 50712 - protein, 7 aa, Artificial
  Synthetic
YASQSFS

SEQ ID NO: 50713 - protein, 9 aa, Artificial
  Synthetic
HQSRRLPLT

SEQ ID NO: 50714 - protein, 11 aa, Artificial
  Synthetic
QGDSLRPYYAS

SEQ ID NO: 50715 - protein, 7 aa, Artificial
  Synthetic
GKNNRPS

SEQ ID NO: 50716 - protein, 12 aa, Artificial
  Synthetic
NSRDSSGNHLVV

SEQ ID NO: 50717 - protein, 16 aa, Artificial
  Synthetic
RSSQSLVYSDGNTYLN

SEQ ID NO: 50718 - protein, 7 aa, Artificial
  Synthetic
KVSNWDS

SEQ ID NO: 50719 - protein, 9 aa, Artificial
  Synthetic
MQGTHWPLT

SEQ ID NO: 50720 - protein, 11 aa, Artificial
  Synthetic
RASQSVSRNLA

SEQ ID NO: 50721 - protein, 7 aa, Artificial
  Synthetic
GASTRAT

SEQ ID NO: 50722 - protein, 9 aa, Artificial
  Synthetic
QQYNNWPLT

SEQ ID NO: 50723 - protein, 11 aa, Artificial
  Synthetic
GGNNIGRKNVH

SEQ ID NO: 50724 - protein, 7 aa, Artificial
  Synthetic
RDSDRPS

SEQ ID NO: 50725 - protein, 9 aa, Artificial
  Synthetic
QVWDSSTVV

SEQ ID NO: 50726 - protein, 9 aa, Artificial
  Synthetic
LHQYSYPRT

SEQ ID NO: 50727 - protein, 13 aa, Artificial
  Synthetic
RETYNWNYEGFDY

SEQ ID NO: 50728 - protein, 11 aa, Artificial
  Synthetic
SGDALPKKYAY

SEQ ID NO: 50729 - protein, 11 aa, Artificial
  Synthetic
NSTDSSGNHVV

SEQ ID NO: 50730 - protein, 4 aa, Artificial
  Synthetic
KFGD

SEQ ID NO: 50731 - protein, 5 aa, Artificial
  Synthetic
VYYLN

SEQ ID NO: 50732 - protein, 7 aa, Artificial
  Synthetic
GYDILTG

SEQ ID NO: 50733 - protein, 5 aa, Artificial
  Synthetic
SYSWS

SEQ ID NO: 50734 - protein, 16 aa, Artificial
  Synthetic
RIYTSGSTNYIPSLKS

SEQ ID NO: 50735 - protein, 12 aa, Artificial
  Synthetic
DLKSSGCLFFDY

SEQ ID NO: 50736 - protein, 8 aa, Artificial
  Synthetic
GGSRGFDP

SEQ ID NO: 50737 - protein, 11 aa, Artificial
  Synthetic
NRGVGYYGLDV

SEQ ID NO: 50738 - protein, 16 aa, Artificial
  Synthetic
EINLSGSTNYNPSLKS

SEQ ID NO: 50739 - protein, 10 aa, Artificial
  Synthetic
WYYYYYGMDV

SEQ ID NO: 50740 - protein, 5 aa, Artificial
  Synthetic
GYFWT

SEQ ID NO: 50741 - protein, 6 aa, Artificial
  Synthetic
DYGADY

SEQ ID NO: 50742 - protein, 8 aa, Artificial
  Synthetic
TYSGGMDV

SEQ ID NO: 50743 - protein, 5 aa, Artificial
  Synthetic
SYDIN

SEQ ID NO: 50744 - protein, 17 aa, Artificial
  Synthetic
WMNPKRGNTGYAQKFQG

SEQ ID NO: 50745 - protein, 16 aa, Artificial
  Synthetic
GRYSREDYYYYYDMDV

SEQ ID NO: 50746 - protein, 10 aa, Artificial
  Synthetic
QQSYRTPLFT

SEQ ID NO: 50747 - protein, 17 aa, Artificial
  Synthetic
IISYVGKNKYYADSVKG

SEQ ID NO: 50748 - protein, 7 aa, Artificial
  Synthetic
DYGAFDI

SEQ ID NO: 50749 - protein, 4 aa, Artificial
  Synthetic
LGDY

SEQ ID NO: 50750 - protein, 9 aa, Artificial
  Synthetic
MQALQTPIT
